US011535869B2

(12) United States Patent
Cruite et al.

(10) Patent No.: US 11,535,869 B2
(45) Date of Patent: Dec. 27, 2022

(54) CD8-SPECIFIC ANTIBODY CONSTRUCTS AND COMPOSITIONS THEREOF

(71) Applicant: Sana Biotechnology, Inc., Seattle, WA (US)

(72) Inventors: Patricia Ann Cruite, Medford, MA (US); Shirisha Amatya, Cambridge, MA (US); Hugh Harding, Framingham, MA (US); Lauren Pepper MacKenzie, Belmont, MA (US)

(73) Assignee: Sana Biotechnology, Inc., Seattle, WA (US)

( * ) Notice: Subject to any disclaimer, the term of this patent is extended or adjusted under 35 U.S.C. 154(b) by 0 days.

(21) Appl. No.: 17/715,253

(22) Filed: Apr. 7, 2022

(65) Prior Publication Data

US 2022/0333134 A1 Oct. 20, 2022

Related U.S. Application Data

(60) Provisional application No. 63/299,254, filed on Jan. 13, 2022, provisional application No. 63/172,518, filed on Apr. 8, 2021.

(51) Int. Cl.

| | |
|---|---|
| *C12N 15/86* | (2006.01) |
| *C07K 16/28* | (2006.01) |
| *C07K 14/705* | (2006.01) |
| *C07K 14/725* | (2006.01) |
| *A61P 35/00* | (2006.01) |
| *A61P 35/04* | (2006.01) |
| *C07K 14/005* | (2006.01) |
| *A61K 39/00* | (2006.01) |
| *A61K 38/00* | (2006.01) |

(52) U.S. Cl.

CPC .............. *C12N 15/86* (2013.01); *A61P 35/00* (2018.01); *A61P 35/04* (2018.01); *C07K 14/005* (2013.01); *C07K 14/7051* (2013.01); *C07K 14/70517* (2013.01); *C07K 14/70521* (2013.01); *C07K 14/70578* (2013.01); *C07K 16/2803* (2013.01); *C07K 16/2815* (2013.01); *A61K 38/00* (2013.01); *A61K 2039/505* (2013.01); *A61K 2039/545* (2013.01); *C07K 2317/569* (2013.01); *C07K 2317/622* (2013.01); *C07K 2317/76* (2013.01); *C07K 2317/92* (2013.01); *C07K 2319/02* (2013.01); *C07K 2319/33* (2013.01); *C12N 2740/15043* (2013.01); *C12N 2760/18222* (2013.01); *C12N 2760/18233* (2013.01); *C12N 2760/18271* (2013.01)

(58) Field of Classification Search
CPC ...................... C07K 14/70517; C07K 16/2815
See application file for complete search history.

(56) References Cited

U.S. PATENT DOCUMENTS

| | | | |
|---|---|---|---|
| 9,486,539 B2 | 11/2016 | Lee et al. | |
| 10,064,958 B2 | 9/2018 | Lee et al. | |
| 2003/0207445 A1 | 11/2003 | Schauber et al. | |
| 2005/0070493 A1 | 3/2005 | Fawell et al. | |
| 2007/0031455 A1 | 8/2007 | Audonnet | |
| 2009/0041724 A1 | 2/2009 | Steen et al. | |
| 2017/0165348 A1 | 6/2017 | Cantore et al. | |
| 2017/0368098 A1* | 12/2017 | Chen | C07K 16/2887 |
| 2019/0023790 A1 | 1/2019 | Regeneron | |
| 2019/0125898 A1 | 5/2019 | Lee et al. | |
| 2019/0144885 A1* | 5/2019 | Costa Fejoz | C07K 14/005 424/93.2 |
| 2020/0060980 A1 | 2/2020 | Von Maltzahn et al. | |
| 2021/0137839 A1 | 5/2021 | Von Maltzahn et al. | |
| 2021/0187018 A1 | 6/2021 | Von Maltzahn et al. | |
| 2021/0198698 A1 | 7/2021 | Von Maltzahn et al. | |
| 2021/0228627 A1 | 7/2021 | Von Maltzahn et al. | |
| 2021/0353543 A1* | 11/2021 | Trudeau | C07K 16/2812 |
| 2022/0241328 A1* | 8/2022 | Bandoro | A61K 39/001124 |

FOREIGN PATENT DOCUMENTS

| | | |
|---|---|---|
| EP | 2615176 | 7/2013 |
| WO | WO 2000/017374 | 3/2000 |
| WO | WO 2001/074861 | 10/2001 |
| WO | WO 2006/028786 | 3/2006 |
| WO | WO 2006/059141 | 6/2006 |
| WO | WO 2006/078221 | 7/2006 |
| WO | WO 2007/005244 | 1/2007 |
| WO | WO 2008/037458 | 4/2008 |
| WO | WO 2008/071959 | 6/2008 |
| WO | WO 2008/081008 A1 | 7/2008 |
| WO | WO 2008/115199 | 9/2008 |
| WO | WO 2009/130208 | 10/2009 |

(Continued)

OTHER PUBLICATIONS

Single Domain Antibodies, Single-Domain Antibodies—MeSH—NCBI (nih.gov), 2013 (Year: 2013).*
Abengozar et al., "Blocking ephrinB2 with highly specific antibodies inhibits angiogenesis, lymphangiogenesis, and tumor growth". Blood 119(19):4565-76, 2012.
Aguilar et al. "N-glycans on nipah virus fusion protein protect against neutrilization but reduce membrane fusion and viral entry", Virol. (80) 4878-4889, 2006.
Aguilar et al., "Polybasic KKR Motif in the Cytoplasmic Tail of Nipah Virus Fusion Protein Modulates Membrane Fusion by Inside-Out Signaling," J Viral (2007) 81:4520-4532.
Alam et al., "Coexpression of EphB4 and ephrinB2 in tumor advancement of uterine cervical cancers", Gynecologic Oncology 114(1):84-88, 2009.

(Continued)

*Primary Examiner* — Peter J Reddig
(74) *Attorney, Agent, or Firm* — Finnegan, Henderson, Farabow, Garrett & Dunner, LLP

(57) ABSTRACT

Disclosed herein are antibodies or antigen binding fragments thereof that specifically bind human CD8. Also disclosed are fusion proteins comprising a Henipavirus glycoprotein G and CD8 antibodies for targeting and transducing cells expressing CD8. Viral vectors and other compositions containing the fusion proteins, as well as methods of using the fusion proteins, are also disclosed.

30 Claims, 17 Drawing Sheets

Specification includes a Sequence Listing.

(56) References Cited

FOREIGN PATENT DOCUMENTS

| WO | WO 2010/053489 | | 5/2010 | | |
|---|---|---|---|---|---|
| WO | WO 2011/011584 | | 1/2011 | | |
| WO | WO 2011/058052 | | 5/2011 | | |
| WO | WO 2012/095535 | | 7/2012 | | |
| WO | WO 2012/149376 | | 11/2012 | | |
| WO | WO 2013/084000 | | 6/2013 | | |
| WO | WO 2013/148327 | | 10/2013 | | |
| WO | WO 2014/076137 | | 5/2014 | | |
| WO | WO 2014/164553 | | 10/2014 | | |
| WO | WO 2015/011478 | | 1/2015 | | |
| WO | WO 2015/110957 | | 7/2015 | | |
| WO | WO 2016/138525 | | 9/2016 | | |
| WO | WO 2016/183482 | | 11/2016 | | |
| WO | WO 2017/151717 | | 9/2017 | | |
| WO | WO 2017/165245 | | 9/2017 | | |
| WO | WO 2017/173034 | | 10/2017 | | |
| WO | WO 2017/182585 | | 10/2017 | | |
| WO | WO 2017/211945 | | 12/2017 | | |
| WO | WO 2018/009923 | | 1/2018 | | |
| WO | WO 2018/022749 | | 2/2018 | | |
| WO | WO 2018/129563 | | 7/2018 | | |
| WO | WO 2018/208728 | | 11/2018 | | |
| WO | WO 2019/113512 | | 6/2019 | | |
| WO | WO 2019/152692 | | 8/2019 | | |
| WO | WO 2019/161281 | | 8/2019 | | |
| WO | WO 2019/222403 | | 11/2019 | | |
| WO | WO-2019217964 | A1 * | 11/2019 | ......... | A61M 1/0281 |
| WO | WO 2020/014209 | | 1/2020 | | |
| WO | WO 2020/092554 | A1 | 5/2020 | | |
| WO | WO 2020/102485 | | 5/2020 | | |
| WO | WO 2020/102499 | | 5/2020 | | |
| WO | WO 2020/102503 | | 5/2020 | | |
| WO | WO 2020/102578 | | 5/2020 | | |

OTHER PUBLICATIONS

Anliker et al., Specific gene transfer to neurons, endothelial cells and hematopoietic progenitors with lentiviral vectors, 7(11) Nature Methods 929-937 (Nov. 2010).

Barile et al., "Exosomes: Therapy delivery tools and biomarkers of diseases," Pharmacol Ther. (2017) 174: 63-78.

Bender et al., "Developing an Engineered Nipah Virus Glycoprotein Based Lentiviral Vector System Retargeted to Cell Surface Receptors of Choice," Mol. Ther. (2015) 23(1); S2.

Bender et al., "Receptor-Targeted Nipah Virus Glycoproteins Improve Cell-Type Selective Gene Delivery and Reveal a Preference for Membrane-Proximal Cell Attachment," PLOS Pathogens 12(6):e1005641.

Biering et al. "N-glycans on the nipah virus attachment glycoprotein modulate fusion and viral entry as they protect against antibody neutrilization" J Virol. (2012) 86(22): 11991-12002.

Bishop et al., "Identification of Hendra Virus G Glycoprotein Residues That Are Critical for Receptor Binding," J Viral (2007) 81:5893-5901.

Bowden et al., "Structural basis of Nipah and Hendra virus attachment to their cell-surface receptor ephrin-B2," Nature Structural & Molecular Biology (2008) 15(6):567-572.

Chiriaco et al., "Dual-regulated lentiviral vector for gene therapy of X linked chronic granulomatosis." Molecular Therapy (2014) 22(8): 1472-1483.

Enkirch et al., *Targeted lentiviral vectors pseudotyped with the* Tupaia paramyxovirus *glycoproteins*, 20(1) Gene Therapy 16-23 (2013).

Field et al.,"Comparison of lentiviral and sleeping beauty mediated alpha&bgr T cell receptor gene transfer." Plos One (2013) 8(6): e68201.

Frecha et al., *Stable transduction of quiescent T cells without induction of cycle progression by a novel lentiviral vector pseudotyped with measles virus glycoproteins*, 112(13) Blood 4843-4852 (Dec. 15, 2008).

Friedel et al., "Receptor-targeted lentiviral vectors are exceptionally sensitive toward the biophysical properties of the displayed single-chain Fv," Protein Eng Des Sel. (2015) 28(4): 93-106. doi: 10.1093/protein/gzv005.

Funke et al., *Targeted Cell Entry of Lentiviral Vectors*, 16(8) Molecular Therapy 1427-1436 (Aug. 2008).

Guillaume et al., "Evidence of a Potential Receptor-Binding Site on the Nipah Virus G Protein (NiV-G): Identification of Globular Head Residues with a Role in Fusion Promotion and Their Localization on an NiV-G Structural Model," J Viral (2006) 80:7546-7554.

Haga et al.,"Permanent, lowered HLA class I expression using lentivirus vectors with shRNA constructs: averting cytotoxicity by alloreactive T lymphocytes." Transplantation Proceedings (2006) 38(10):3184-3188.

Imamura et al., *Autonomous growth and increased cytotoxicity of natural killer cells expressing membrane-bound interleukin-15*, 124(7) Blood 1081-1088 (Aug. 2014).

Khetawat et al., "A Functional Henipavirus Envelope Glycoprotein Pseudotyped Lentivirus Assay System," Khetawat and Broder Virology Journal (2010) 7:312.

Kneissl et al., *Measles Virus Glycoprotein-Based Lentiviral Targeting Vectors That Avoid Neutralizing Antibodies*, 7(10) Plos One 1-8 (Oct. 2012).

Lattanzi et al. "A Strategy of antigen incoperation into exosomes: Comparing cross-presentation levels of antigens delivered by engineered exosomes and by lentiviral virus-like particles", Vaccine (2012) col. 20, No. 50; 7229.

Leavitt et al., "Concordant modulation of neutrilization resistance and high infectivity of the primary human immunodeficiency virus type 1 MN strain and definition of a potential gp41 binding site in gp120". Journal of Virology 560-570, 2003.

Lee et al. "Modes of paramyxovirus fusion: a Henipavirus perspective" 2011. Trends in Microbiology.Aug;19(8):389-99.

Lentz et al. "Review, viral vectors for gene delivery to the central nervous system" Neurobiology of Disease 48:179-188, 2012.

Levy et al., "Surface engineering of lentiviral vectors for gene transfer into gene therapy target cells," Current Opinion in Pharmacology (2015) 24:79-85.

Milani et al., "Genome editing for scalable produciton of alloantigen free lentiviral vectors for in vivo gene therapy." EMBO Molecular Medicine (2017) 9(11): 1558-1573.

Montagna et al., "VSV-G-Enveloped Vesicles for Traceless Delivery of CRISPR-Cas9" Mol Ther Nucleic Acids. (2018) 12:453-462.

Morizono et al., "Redirecting lentiviral vectors pseudotyped with sinbis virus-derived envelope proteins to DC-SIGN by modificiation of N-linked glycans of envelope proteins," J Virol. (2010) 84(14): 6923-34.

Munch et al., DARPins: An Efficient Targeting Domain for Lentiviral Vectors, 19(4) Molecular Therapy 686-693 (2011).

Munch et al., "Off-target-freegene delivery by affinity-purified receptor-targeted viral vectors," Nature Communications (2015) 6:6246.

Nakamura et al., "Antibody-targeted cell fusion," Nat Biotechnol. (2004) 22(3): 331-336.

Needleman et al., A General Method Applicable to the Search for Similarities in the Amino Acid Sequence of Two Proteins, 48 J. Mol. Biol. 443- 453 (1970).

Negrete et al., "EphrinB2 is the entry receptor for Nipah virus, an emergent deadly paramyxovirus", Nature (436)401-405, 2005.

Negrete et al., "Single Amino Acid Changes in the Nipah and Hendra Virus Attachment Glycoproteins Distinguish EphrinB2 from EphrinB3 Usage," J Viral (2007) 81(19):10804-10814.

Nordlund et al.,"SNARE-fusion mediated insertion of membrane proteins into native and artificial membranes." Nat Commun. (2014) 5: 4303.

Palomares et al., "Nipah Virus Envelope-Pseudotyped Lentiviruses Efficiently Target ephrinB2-Positive Stem Cell Populations In Vitro and Bypass the Liver Sink When Administered In Vivo," J Viral (2013) 87:2094-2108.

Richard et al., "Specific Micro-RNA regulated TetR-KRAB Transcriptional control of transgene expression in viral vector transduced cells," Plos One (2012) 7(12):e51952.

(56) References Cited

OTHER PUBLICATIONS

Riazifar et al., "Stem Cell Extracellular Vesicles: Extended Messages of Regeneration," Annu Rev Pharmacol Toxicol. (2017) 57: 125-154.
Schauber-Plewa et al., "Complement regulatory proteins are incorporated into lentiviral vectors and protect particles against complement inactivation." Gene Therapy. (2004) 12(3): 238-245.
Sosale et al., "Marker of self: CD47 on lentiviral vectors decreases macrophage-mediated clearance and increases delivery to SIRPA-expressing lung carcinoma tumors." Molecular Therapy (2016) 3(7): 16080.
Stefan et al., "DARPins recognizing the tumor-associated antigen EpCAM selected by phage and ribosome display and engineered for multivalency," J Mol Biol. (2011) 413(4): 826-43.
Steffen et al., "Henipavirus mediated membrane fusion, virus entry and targeted therapeutics," Viruses (2012) 4:280-309.
Tang et al., "Therapeutic potential of CAR-T cell-derived exosomes: a cell-free modality for targeted cancer therapy." Oncotarget (2015) 6(42); 44179-44190.
Tomas et al., "Improved GaLV-TR glycoproteins to pseudotype lentiviral vectors: impact of viral protease activity in the production of LV pseudotypes." Molecular Therapy (2019) 15: 1-8.
Verhoeyen et al., "Lentiviral vector gene transfer into human T cells," Methods in Mal Biol (2009) 506:97-114.
Verhoeyen et al., *IL-7 surface-engineered lentiviral vectors promote survival and efficient gene transfer in resting primary Tlymphocytes*, 101 (6) Blood 2167-2174 (Mar. 15, 2003).
Weiss et al., "Review, The blood-brain barrier in brain homeostasis and neurological diseases" Biochimica Biophys Acta. (2009) 1788: 841-857.
White et al., "Structures and mechanisms of viral membrane fusion proteins: multiple variations on a common theme," Crit Rev Biochem Mol Biol. (2008) 43(3): 189-219.

Witting S.R. et al., Characterization of a 3rd Generation Lentiviral Vector Pseudotyped With Nipah Virus Envelope Proteins for Endothelial Cell Transduction. Gene Ther, May 23, 2013, vol. 20, No. 10.
Xu et al., "Host cell recognition by the henipaviruses: Crystal structures of the Nipah G attachment glycoprotein and its complex with ephrin-B3," PNAS (2008) 105(29):9953-9958.
Xu et al., "New Insights into the Hendra Virus Attachment and Entry Process from Structures of the Virus G Glycoprotein and Its Complex with Ephrin-B2," PLOS One (2012) 7(11):e48742.
Yang et al., "Virus-mimetic fusogenic exosomes for direct delivery of integral membrane proteins to target cell membranes." Advanced Materials (2017) 29(13): 1605604.
Zakaria et al., "Combination of hepatocyte specific delivery and transformation dependent expression of shRNA inducing transcriptional gene silencing of c-Myc promoter in hepatocellular carcinoma cells", BMC Cancer, Biomed Central, London (2014) 14(1): 582.
Zhang et al., "Cell specific targeting of lentiviral vector mediated by fusion proteins derived from Sindbis virus, vesicular stomatitis virus, or avian sarcoma/leukosis virus", Retrovirology 7(3) 1-15, 2010.
Zhou et al., "Cell type specific gene delivery by lentiviral vectors," Onco Immunolgy (2013) 2:e22566.
Zhou Q et al. Tcell receptor gene transfer exclusively to human CD8 cells enhances tumor killing. Blood Aug. 16, 2012, vol. 120 No. 22:4334.
Zhou et al.. Exclusive Transduction of Human CD4+ T Cells upon Systemic Delivery of CD4-Targeted Lentiviral Vectors, 195(5) J. Immunol. 2493-2501 (2015).
International Search Report dated Jun. 13, 2017, in corresponding PCT Application No. PCT/EP2017/059435.

* cited by examiner

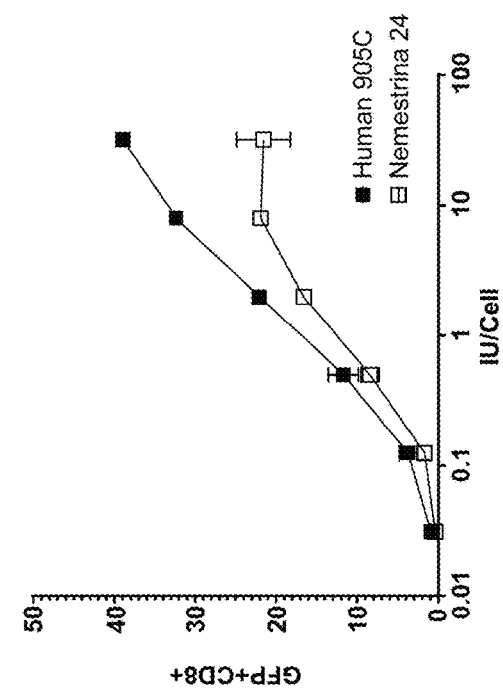
FIG. 7A
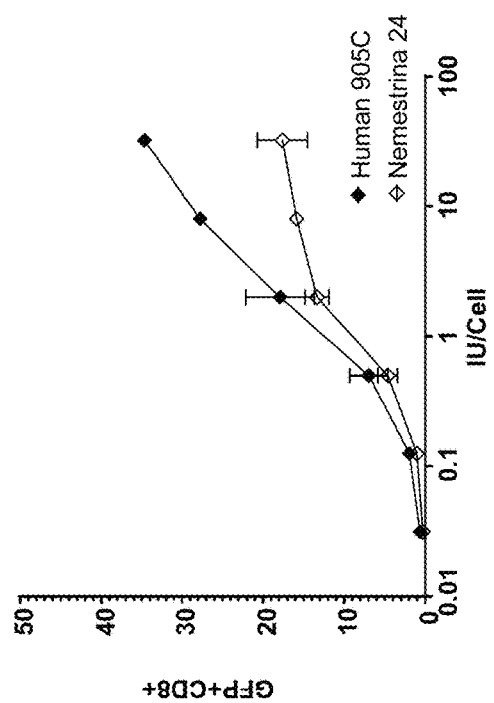
FIG. 7C
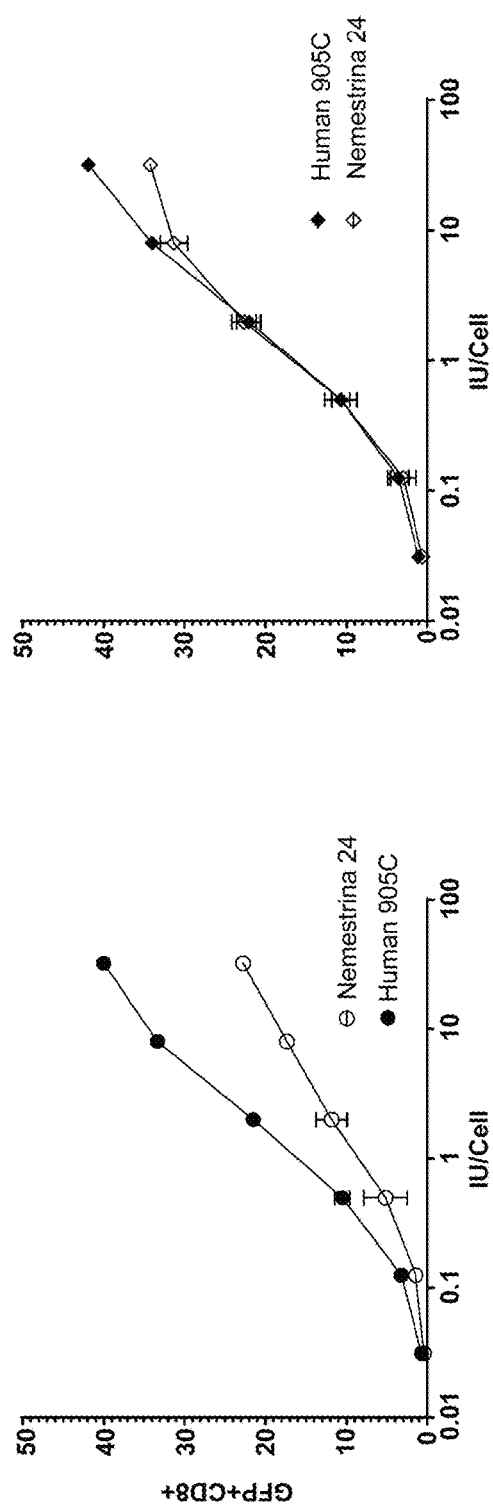
FIG. 7B
FIG. 7D

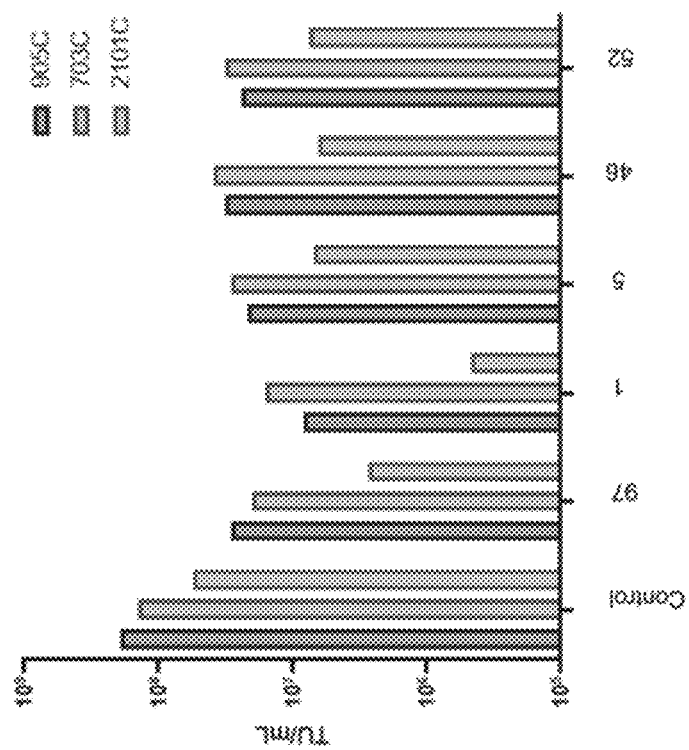
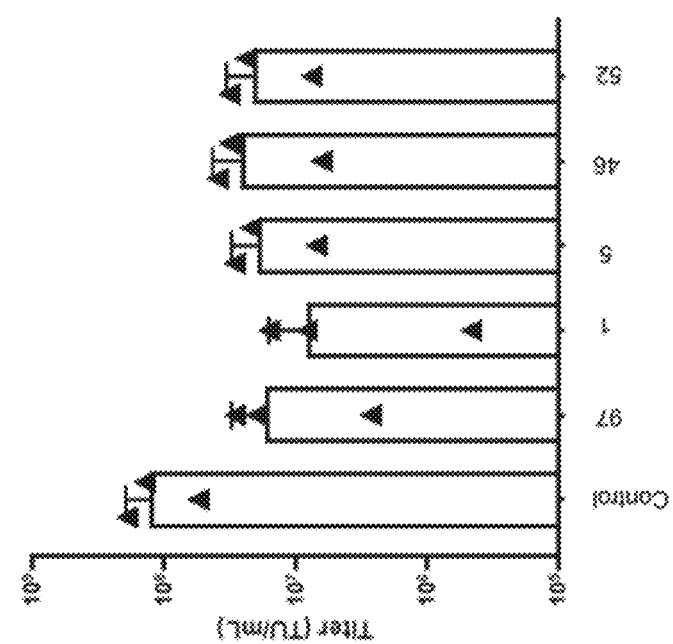
FIG. 8B
FIG. 8A

CD8-SPECIFIC ANTIBODY CONSTRUCTS AND COMPOSITIONS THEREOF

CROSS-REFERENCE TO RELATED APPLICATIONS

This application claims priority to U.S. Provisional Application No. 63/299,254, filed Jan. 13, 2022, and U.S. Provisional Application No. 63/172,518, filed Apr. 8, 2021. The contents of these applications are each incorporated herein by reference in their entirety.

SEQUENCE LISTING

The instant application contains a Sequence Listing which has been submitted electronically in ASCII format and is hereby incorporated by reference in its entirety. Said ASCII copy, created on Apr. 6, 2022, is named 15147_0005-00000_SL.txt and is 760 kilobytes in size.

FIELD

The present disclosure relates to antibodies or antigen binding fragments thereof that specifically bind human CD8. Also disclosed are fusion proteins comprising a Henipavirus glycoprotein G and a CD8 antibody, or an antigen binding fragment thereof, for targeting and transducing cells expressing CD8. Viral vectors and other compositions containing the fusion proteins, antibodies, or antigen binding fragments thereof, as well as methods of using the fusion proteins, antibodies, or antigen binding fragments thereof are also disclosed.

BACKGROUND

CD8 (cluster of differentiation 8) is a transmembrane glycoprotein that serves as a coreceptor for the T cell receptor (TCR). CD8 serves multiple functions in immune responses against both external and internal challenges. In T cells, the CD8 coreceptor functions primarily to bind to a major histocompatibility complex (MHC) molecule to facilitate T cell signaling and aid with cytotoxic T cell antigen interactions. While it is predominantly expressed on the surface of cytotoxic T cells, the CD8 coreceptor can also be found on natural killer cells, cortical thymocytes, and dendritic cells. The CD8 molecule is also used as a marker for cytotoxic T cell population.

There are two isoforms of the CD8 glycoprotein, alpha and beta, and each is encoded by a different gene. To function, CD8 forms a dimer, consisting of a pair of CD8 chains. The most common form of CD8 is composed of a CD8-α and CD8-β chain. Homodimers of the CD8-α chain are also expressed on some cells. The molecular weight of each CD8 chain is about 34 kDa.

T lymphocytes are among the prime targets in gene therapy, even more so since chimeric antigen receptor (CAR) T cells have reached the clinic. Current approaches for T cell engineering mainly rely on ex vivo gene transfer methods. Following their isolation from either healthy donors or patients, lymphocytes are activated and subsequently transduced by lentiviral vectors. The modified lymphocytes are then expanded and either used in functional in vivo assays or used for in vivo applications. Ex vivo modification of T lymphocytes, however, has its disadvantages. The complexity of the overall procedure, cost of the manufacturing process, and prolonged ex vivo culture negatively impact the quality of the final product. Methods that improve T lymphocyte engineering that use in vivo delivery platforms are needed.

In vivo delivery platforms using fusogenic glycoproteins of viral vectors have been shown to be beneficial for targeting, binding, and transducing cells of interest. Certain fusogenic glycoproteins, however, may not be sufficiently stable or expressed on the surface of the viral vector. Thus, improved fusogenic glycoproteins and viral vectors containing those glycoproteins are needed. The provided disclosure addresses this need.

BRIEF SUMMARY

The present disclosure provides an antibody or antigen binding fragment thereof that specifically binds CD8α or CD8β, comprising certain heavy chain complementarity determining regions (HCDR1, HCDR2, and HCDR3) and/or light chain complementarity determining regions (LCDR1, LCDR2, and LCDR3). Another embodiment is an antibody or antigen binding fragment thereof specifically binding CD8α or CD8β, comprising certain heavy (VH) and/or light (VL) chain variable regions. The disclosure likewise provides for isolated polynucleotides, vectors, and host cells comprising the anti-CD8α or CD8β antibody or antigen binding fragment thereof.

The present disclosure also provides a fusion protein comprising a Henipavirus glycoprotein G (G protein) or a biologically active portion thereof and at least one disclosed CD8 antibody or antigen binding fragment, wherein the antibody or antigen binding fragment is fused to the C-terminus of the G protein or the biologically active portion thereof.

The present disclosure also provides a viral vector comprising a henipavirus F protein molecule or biologically active portion thereof, a henipavirus envelope glycoprotein G (G protein) or a biologically active portion thereof, and at least one disclosed CD8 antibody or antigen binding fragment thereof, wherein the antibody or antigen binding fragment thereof is attached to the C-terminus of the G protein or the biologically active portion thereof.

The present disclosure likewise relates to methods of selectively modulating and transducing CD8+ T cells using the disclosed viral vectors. Also disclosed are methods of delivering an exogenous agent to a subject, comprising administering to the subject the disclosed viral vectors, in which the viral vector further comprises an exogenous agent. The present disclosure also relates to methods of treating cancer in a subject, comprising administering to the subject the disclosed viral vectors.

BRIEF DESCRIPTION OF DRAWINGS

FIGS. 7A-7D shows the transduction effects of a Nipah G pseudotyped viral vector attached to CD8 binder 1 (FIG. 7A), CD8 binder 5 (FIG. 7B), CD8 binder 46 (FIG. 7C), and CD8 binder 52 (FIG. 7D) of the disclosure on human and nemestrina PBMCs (human donor 905C and nemestrina donor 24).

FIGS. 8A-8B show the average titers (FIG. 8A) and titers by donor (905C, 703C, or 2101C) (FIG. 8B) of several CD8 scFvs of the disclosure on human PBMCs.

FIGS. 9A-9B depict the transduction efficiencies of the CD8 binders of the disclosure on human PBMC in transgenic mice in vivo using CD8+ (FIG. 9A) and CD8− (FIG. 9B) cells.

FIGS. 10A-10B depict tumor killing in vitro using CD8 fusogen-generated CD19CAR T cells.

FIGS. 11A-11C depict tumor growth over time following injection of human peripheral blood mononuclear cells (hPBMC) (FIG. 11A), with prior T cell activation with CD3/CD28 complexes, and then injection a day after of CD8-CD19CAR LV, and following injection of non-activated hPBMC (without prior T cell activation), and then injection a day after of CD8-CD19CAR LV (FIG. 11B). FIG. 11C shows the percent of $CD8^+CD19CAR^+$ cells in total recovered live lymphocytes from spleen, bone marrow or peripheral blood following injection of CD8-CD19CAR LV, as indicated in top right quadrant of the FACs plots in both PBMC control (top plots) and CD8 fusosome-treated animals (bottom plots).

FIG. 12 depicts B cell levels in a non-human primate (NHP) model following administration of a lentiviral vector pseudotyped with an anti-CD8 binding protein targeting CD8+ T cells to deliver a CD20 CAR transgene.

FIG. 13 depicts normalized B cell counts in non-human primates following administration of vehicle (Control 1-2) or a lentiviral vector pseudotyped with an anti-CD8 binding protein targeting CD8+ T cells to deliver a CD20 CAR transgene (Treated 1-6).

FIG. 14 depicts an exemplary system for administration of a lentiviral vector comprising a CD8 binding agent to a subject.

DETAILED DESCRIPTION

Unless defined otherwise, all terms of art, notations, and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

Unless defined otherwise, all technical and scientific terms, acronyms, and abbreviations used herein have the same meaning as commonly understood by one of ordinary skill in the art to which the disclosure pertains. Unless indicated otherwise, abbreviations and symbols for chemical and biochemical names is per IUPAC-IUB nomenclature. Unless indicated otherwise, all numerical ranges are inclusive of the values defining the range as well as all integer values in-between.

As used herein, the articles "a" and "an" refer to one or to more than one (i.e. to at least one) of the grammatical object of the article. By way of example, "an element" means one element or more than one element.

As used herein, the term "about" will be understood by persons of ordinary skill in the art and will vary to some extent on the context in which it is used. In some embodiments, the term "about" when referring to a measurable value such as an amount, a temporal duration, and the like, is meant to encompass art-accepted variations based on standard errors in making such measurements. In some embodiments, the term "about" when referring to such values, is meant to encompass variations of ±20% or ±10%, more preferably ±5%, even more preferably ±1%, and still more preferably ±0.1% from the specified value, as such variations are appropriate to perform the disclosed methods.

As used herein, "CD8" or "cluster of differentiation 8" refers to a transmembrane glycoprotein which is a specific marker for a subclass of T cells (which includes cytotoxic T cells). CD8 assembles as either a heterodimer of the CD8 alpha ("CD8α" or "CD8A") and CD8 beta ("CD8β" or "CD8B") subunits ("CD8αβ" or "CD8AB"), or a CD8 alpha homodimer ("CD8αα" or "CD8AA"). The assembled dimeric CD8 complex acts as a coreceptor together with the T cell receptor (TCR) to recognize antigen presentation by MHC class I cells. CD8 plays a role in the development of T cells and activation of mature T cells.

As used herein, "affinity" refers to the strength of the sum total of noncovalent interactions between a single binding site of a molecule (e.g., an antibody) and its binding partner (e.g., an antigen). The affinity of a molecule for its partner can generally be represented by the equilibrium dissociation constant ($K_D$) (or its inverse equilibrium association constant, $K_A$). Affinity can be measured by common methods known in the art, including those described herein. See, for example, Pope M. E., Soste M. V., Eyford B. A., Anderson N. L., Pearson T. W., (2009) *J. Immunol. Methods.* 341(1-2):86-96 and methods described therein.

As used herein, "antibody" is meant in a broad sense and includes immunoglobulin molecules including monoclonal antibodies including murine, human, humanized and chimeric antibodies, antibody fragments, bispecific or multispecific antibodies formed from at least two intact antibodies or antibody fragments, dimeric, tetrameric or multimeric antibodies, single chain antibodies, and any other modified configuration of the immunoglobulin molecule that comprises an antigen recognition site of the required specificity.

Immunoglobulins can be assigned to five major classes, namely IgA, IgD, IgE, IgG, and IgM, depending on the heavy chain constant domain amino acid sequence. IgA and IgG are further sub-classified to IgA1, IgA2, IgG1, IgG2, IgG3, and IgG4. Antibody light chains of any vertebrate species can be assigned to one of two clearly distinct types, namely kappa (κ) and lambda (A), based on the amino acid sequences of their constant domains.

As used herein, "antigen binding fragment" or "antibody fragment" refers to a portion of an immunoglobulin molecule that retains the heavy chain and/or the light chain antigen binding site, such as a heavy chain complementarity determining regions (HCDR) 1 (HCDR1), 2 (HCDR2), and 3 (HCDR3), a light chain complementarity determining regions (LCDR) 1 (LCDR1), 2 (LCDR2), and 3 (LCDR3), a heavy chain variable region (VH), or a light chain variable region (VL). Antibody fragments include a Fab fragment (a monovalent fragment consisting of the VL or the VH); a F(ab) 2 fragment (a bivalent fragment comprising two Fab fragments linked by a disulfide bridge at the hinge region); a Fd fragment consisting of the VH and CH1 domains; a Fv fragment consisting of the VL and VH domains of a single arm of an antibody; a dAb fragment, which consists of a VH domain; and a variable domain (VHH) from, e.g., human or camelid origin. VH and VL domains can be engineered and linked together via a synthetic linker to form various types of single chain antibody designs in which the VH/VL domains pair intramolecularly, or intermolecularly in those cases in which the VH and VL domains are expressed by separate single chain antibody constructs, to form a monovalent antigen binding site, such as a single-chain Fv (scFv) or diabody. These antibody fragments are obtained using well known techniques and the fragments are characterized in the same manner as are intact antibodies.

Figure 1A:
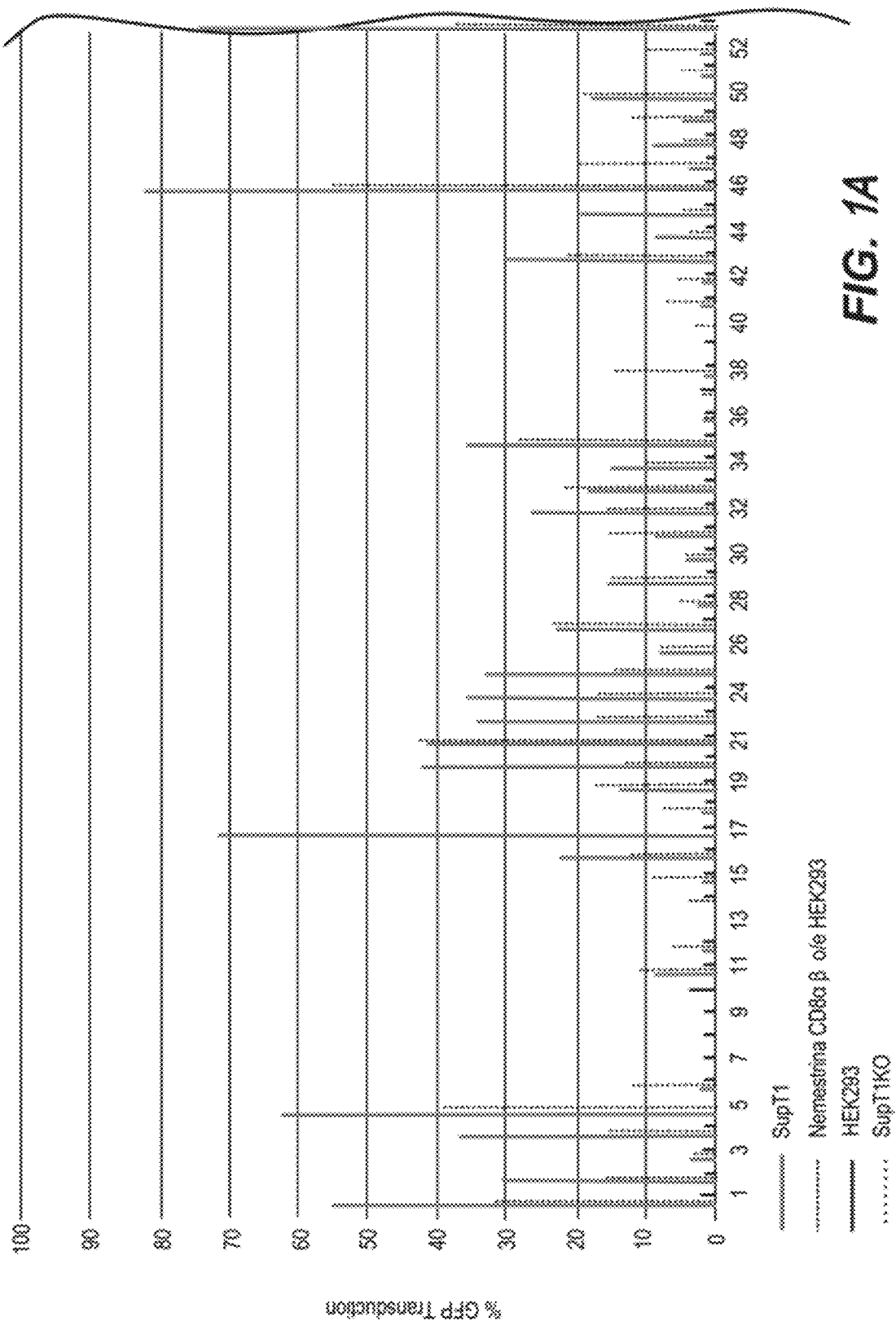
FIG. 1A-1B shows the transduction efficiencies of the disclosed anti-CD8 antibodies in several human cell lines and a cell line expressing M. nemestrina CD8α and CD8β.

An antibody variable region consists of a "framework" region interrupted by three "antigen binding sites." The antigen binding sites are defined using various terms, including, for example (i) "Complementarity Determining Regions" (CDRs), three in the VH (HCDR1, HCDR2, HCDR3) and three in the VL (LCDR1, LCDR2, LCDR3) (Wu and Kabat, *J Exp Med* 132:211-50, 1970; Kabat et al., Sequences of Proteins of Immunological Interest, 5th Ed. Public Health Service, National Institutes of Health, Bethesda, Md., 1991), and (ii) "Hypervariable regions," "HVR," or "HV," three in the VH (H1, H2, H3) and three in the VL (L1, L2, L3) (Chothia and Lesk *Mol Biol* 196:901-17, 1987). Other terms include "IMGT-CDRs" (Lefranc et al., *Dev Comparat Immunol* 27:55-77, 2003) and "Specificity Determining Residue Usage" (SDRU) (Almagro *Mol Recognit*, 17:132-43, 2004). The International ImMunoGeneTics (IMGT) database (http://www_imgt org) provides a standardized numbering and definition of antigen-binding sites. The correspondence between CDRs, HVs, and IMGT delineations is described in Lefranc et al., *Dev Comparat Immunol* 27:55-77, 2003.

The term "framework," or "FR" or "framework sequence" refers to the remaining sequences of a variable region other than those sequences defined to be antigen binding sites. Because the antigen binding site can be defined by various terms as described above, the exact amino acid sequence of a framework depends on how the antigen-binding site was defined.

The term "CDR" denotes a complementarity determining region as defined by at least one manner of identification to one of skill in the art. The precise amino acid sequence boundaries of a given CDR or FR can be readily determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme); Al-Lazikani et al., (1997) JMB 273,927-948 ("Chothia" numbering scheme); MacCallum et al., J. Mol. Biol. 262:732-745 (1996), "Antibody-antigen interactions: Contact analysis and binding site topography," J. Mol. Biol. 262, 732-745." ("Contact" numbering scheme); Lefranc M P et al., "IMGT unique numbering for immunoglobulin and T cell receptor variable domains and Ig superfamily V-like domains," Dev Comp Immunol, 2003 January; 27(1):55-77 ("IMGT" numbering scheme); Honegger A and Plückthun A, "Yet another numbering scheme for immunoglobulin variable domains: an automatic modeling and analysis tool," J Mol Biol, 2001 Jun. 8; 309(3):657-70, ("Aho" numbering scheme); and Martin et al., "Modeling antibody hypervariable loops: a combined algorithm," PNAS, 1989, 86(23):9268-9272, ("AbM" numbering scheme).

The boundaries of a given CDR or FR may vary depending on the scheme used for identification. For example, the Kabat scheme is based on structural alignments, while the Chothia scheme is based on structural information. Numbering for both the Kabat and Chothia schemes is based upon the most common antibody region sequence lengths, with insertions accommodated by insertion letters, for example, "30a," and deletions appearing in some antibodies. The two schemes place certain insertions and deletions ("indels") at different positions, resulting in differential numbering. The Contact scheme is based on analysis of complex crystal structures and is similar in many respects to the Chothia numbering scheme. The AbM scheme is a compromise between Kabat and Chothia definitions based on that used by Oxford Molecular's AbM antibody modeling software.

In some embodiments, CDRs can be defined in accordance with any of the Chothia numbering schemes, the Kabat numbering scheme, the IMGT numbering scheme, a combination of Kabat, IMGT, and Chothia, the AbM definition, and/or the contact definition. A sdAb variable domain comprises three CDRs, designated CDR1, CDR2, and CDR3. Table 1, below, lists exemplary position boundaries of CDR-H1, CDR-H2, CDR-H3 as identified by Kabat, Chothia, AbM, and Contact schemes, respectively. For CDR-H1, residue numbering is listed using both the Kabat and Chothia numbering schemes. FRs are located between CDRs, for example, with FR-H1 located before CDR-H1, FR-H2 located between CDR-H1 and CDR-H2, FR-H3 located between CDR-H2 and CDR-H3 and so forth. It is noted that because the shown Kabat numbering scheme places insertions at H35A and H35B, the end of the Chothia CDR-H1 loop when numbered using the shown Kabat numbering convention varies between H32 and H34, depending on the length of the loop.

TABLE 1

Boundaries of CDRs according to various numbering schemes.

| CDR | Kabat | Chothia | AbM | Contact |
|---|---|---|---|---|
| CDR-H1 (Kabat Numbering[1]) | H31-H35B | H26-H32. . . 34 | H26-H35B | H30-H35B |
| CDR-H1 (Chothia Numbering[2]) | H31-H35 | H26-H32 | H26-H35 | H30-H35 |
| CDR-H2 | H50-H65 | H52-H56 | H50-H58 | H47-H58 |
| CDR-H3 | H95-H102 | H95-H102 | H95-H102 | H93-H101 |

[1]Kabat et al. (1991), "Sequences of Proteins of Immunological Interest," 5th Ed. Public Health Service, National Institutes of Health, Bethesda, MD
[2]Al-Lazikani et al., (1997) JMB 273,927-948.

Thus, unless otherwise specified, a "CDR" or "complementary determining region," or individual specified CDRs (e.g., CDR-H1, CDR-H2, CDR-H3), of a given antibody or region thereof, such as a variable region thereof, should be understood to encompass a (or the specific) complementary determining region as defined by any of the aforementioned schemes. For example, where it is stated that a particular CDR (e.g., a CDR-H3) contains the amino acid sequence of a corresponding CDR in a given sdAb amino acid sequence, it is understood that such a CDR has a sequence of the corresponding CDR (e.g., CDR-H3) within the sdAb, as defined by any of the aforementioned schemes. It is understood that any antibody, such as a sdAb, includes CDRs and such can be identified according to any of the other aforementioned numbering schemes or other numbering schemes known to a skilled artisan.

As used herein, "Fv" refers to the minimum antibody fragment which contains a complete antigen-recognition and antigen-binding site. This region consists of a dimer of one heavy chain and one light chain variable domain in tight, non-covalent association. It is in this configuration that the three hypervariable regions of each variable domain interact to define an antigen-binding site on the surface of the VH-VL dimer. Collectively, the six hypervariable regions confer antigen-binding specificity to the antibody. However, even a single variable domain (or half of an Fv comprising only three hypervariable regions specific for an antigen) may have the ability to recognize and bind an antigen, although at a lower affinity than the entire binding site.

As used herein, "single-chain Fv" or "scFv" antibody fragments comprise the VH and VL domains of an antibody, wherein these domains are present in a single polypeptide chain. Preferably, the Fv polypeptide further comprises a polypeptide linker between the VH and VL domains which enables the scFv to form the desired structure for antigen binding. For a review of scFv see Pluckthun in The Pharmacology of Monoclonal Antibodies, vol. 113, Rosenburg and Moore eds., Springer-Verlag, New York, pp. 269-315 (1994).

As used herein, "VHH" or "VHH antibodies" refer to single domain antibodies that consist of the variable region of a heavy chain of an IgG antibody. For example, the terms "VHH" and "VHH antibody" can refer to the antigen binding domain of a heavy chain IgG (hcIgG) molecule produced by a Camelidae family mammal (e.g., llamas, camels, and alpacas).

As used herein, the term "specifically binds" to a target molecule, such as an antigen, means that a binding molecule, such as a single domain antibody, reacts or associates more frequently, more rapidly, with greater duration, and/or with greater affinity with a particular target molecule than it does with alternative molecules. A binding molecule, such as a sdAb or scFv, "specifically binds" to a target molecule if it binds with greater affinity, avidity, more readily, and/or with greater duration than it binds to other molecules. It is understood that a binding molecule, such as a sdAb or scFv, that specifically binds to a first target may or may not specifically bind to a second target. As such, "specific binding" does not necessarily require (although it can include) exclusive binding.

As used herein, "percent (%) amino acid sequence identity" and "homology" with respect to a peptide, polypeptide or antibody sequence are used interchangeably and are defined as the percentage of amino acid residues in a candidate sequence that are identical with the amino acid residues in another peptide or polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN, or MEGALIGN (DNASTAR) software. Those skilled in the art can determine appropriate parameters for measuring alignment, including any algorithms needed to achieve maximal alignment over the full length of the sequences being compared.

An amino acid substitution may include but is not limited to the replacement of one amino acid in a polypeptide with another amino acid. Exemplary amino acid substitutions are shown in Table 2. Amino acid substitutions may be introduced into an antibody of interest and the products screened for a desired activity, for example, retained/improved binding.

TABLE 2

| Original Residue | Exemplary Substitutions |
| --- | --- |
| Ala (A) | Val; Leu; Ile |
| Arg (R) | Lys; Gin; Asn |
| Asn (N) | Gin; His; Asp, Lys; Arg |
| Asp (D) | Glu; Asn |
| Cys (C) | Ser; Ala |
| Gin (Q) | Asn; Glu |
| Glu (E) | Asp; Gin |
| Giy (G) | Ala |
| His (H) | Asn; Gin; Lys; Arg |
| Ile (I) | Leu; Val; Met; Ala; Phe; Norleucine |
| Leu (L) | Norleucine; Ile; Val; Met; Ala; Phe |
| Lys (K) | Arg; Gin; Asn |
| Met (M) | Leu; Phe; Ile |
| Phe (F) | Trp; Leu; Val; Ile; Ala; Tyr |
| Pro (P) | Ala |
| Ser (S) | Thr |
| Thr (T) | Val; Ser |
| Trp (W) | Tyr; Phe |
| Tyr (Y) | Trp; Phe; Thr; Ser |
| Val (V) | Ile; Leu; Met; Phe; Ala; Norleucine |

Amino acids may be grouped according to common side-chain properties:
(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class. The term, "corresponding to" with reference to nucleotide or amino acid positions of a sequence, such as set forth in the Sequence Listing, refers to nucleotides or amino acid positions identified upon alignment with a target sequence based on structural sequence alignment or using a standard alignment algorithm, such as the GAP algorithm. For example, corresponding residues of a similar sequence (e.g. fragment or species variant) can be determined by alignment to a reference sequence by structural alignment methods. By aligning the sequences, one skilled in the art can identify corresponding residues, for example, using conserved and identical amino acid residues as guides.

The term "isolated" as used herein refers to a molecule that has been separated from at least some of the components with which it is typically found in nature or produced. For example, a polypeptide is referred to as "isolated" when it is separated from at least some of the components of the cell in which it was produced. When a polypeptide is secreted by a cell after expression, physically separating the supernatant containing the polypeptide from the cell that produced it is considered to be "isolating" the polypeptide. Similarly, a polynucleotide is referred to as "isolated" when it is not part of the larger polynucleotide (such as, for example, genomic DNA or mitochondrial DNA, in the case of a DNA polynucleotide) in which it is typically found in nature, or is separated from at least some of the components of the cell in which it was produced. Thus, a DNA polynucleotide that is contained in a vector inside a host cell may be referred to as "isolated."

As used herein, "lipid particle" refers to any biological or synthetic particle that contains a bilayer of amphipathic lipids enclosing a lumen or cavity. Typically, a lipid particle does not contain a nucleus. Examples of lipid particles include nanoparticles, viral-derived particles, or cell-derived particles. Such lipid particles include, but are not limited to, viral particles (e.g. lentiviral particles), virus-like particles, viral vectors (e.g., lentiviral vectors), exosomes, enucleated cells, vesicles (e.g., microvesicles, membrane vesicles, extracellular membrane vesicles, plasma membrane vesicles, and giant plasma membrane vesicles), apoptotic bodies, mitoparticles, pyrenocytes, or lysosomes. In some embodiments, a lipid particle can be a fusosome. In some embodiments, the lipid particle is not a platelet.

As used herein a "biologically active portion," such as with reference to a protein such as a G protein or an F protein, refers to a portion of the protein that exhibits or retains an activity or property of the full-length of the protein. For example, a biologically active portion of an F protein retains fusogenic activity in conjunction with the G protein when each are embedded in a lipid bilayer. A biologically active portion of the G protein retains fusogenic activity in conjunction with an F protein when each is embedded in a lipid bilayer. The retained activity can include 10%-150% or more of the activity of a full-length or wild-type F protein or G protein. Examples of biologically active portions of F and G proteins include truncations of the cytoplasmic domain, e.g. truncations of up to 1, 2, 3, 4, 5, 6, 7, 8 9, 10, 11, 12, 13, 14, 15, 20, 22, 25, 30, 33, 34, 35, or more contiguous amino acids, see e.g. Khetawat and Broder 2010 Virology Journal 7:312; Witting et al. 2013 Gene Therapy 20:997-1005; published international; patent application No. WO/2013/148327.

As used herein, "G protein" refers to a henipavirus envelope attachment glycoprotein G or biologically active portion thereof. "F protein" refers to a henipavirus fusion protein F or biologically active portion thereof. The F and G proteins may be from a Hendra (HeV) or a Nipah (NiV) virus, and may be a wild-type protein or may be a variant thereof that exhibits reduced binding for the native binding partner. The F (fusion) and G (attachment) glycoproteins mediate cellular entry of Nipah virus. The G protein initiates infection by binding to the cellular surface receptor ephrin-B2 (EphB2) or EphB3. The subsequent release of the viral genome into the cytoplasm is mediated by the action of the F protein, which induces the fusion of the viral envelope with cellular membranes. The efficiency of transduction of targeted lipid particles can be improved by engineering hyperfusogenic mutations in one or both of the F protein (such as NiV-F) and G protein (such as NiV-G).

As used herein, "fusosome" refers to a particle containing a bilayer of amphipathic lipids enclosing a lumen or cavity and a fusogen that interacts with the amphipathic lipid bilayer. In some embodiments, the fusosome comprises a nucleic acid. In some embodiments, the fusosome is a membrane enclosed preparation. In some embodiments, the fusosome is derived from a source cell. As used herein, "fusosome composition" refers to a composition comprising one or more fusosomes.

As used herein, "fusogen" refers to an agent or molecule that creates an interaction between two membrane enclosed lumens. In embodiments, the fusogen facilitates fusion of the membranes. In other embodiments, the fusogen creates a connection, e.g., a pore, between two lumens (e.g., a lumen of a retroviral vector and a cytoplasm of a target cell). In some embodiments, the fusogen comprises a complex of two or more proteins, e.g., wherein neither protein has fusogenic activity alone. In some embodiments, the fusogen comprises a targeting domain.

As used herein, a "re-targeted fusogen" refers to a fusogen that comprises a targeting moiety having a sequence that is not part of the naturally-occurring form of the fusogen. In embodiments, the fusogen comprises a different targeting moiety relative to the targeting moiety in the naturally-occurring form of the fusogen. In embodiments, the naturally-occurring form of the fusogen lacks a targeting domain, and the re-targeted fusogen comprises a targeting moiety that is absent from the naturally-occurring form of the fusogen. In embodiments, the fusogen is modified to comprise a targeting moiety. In embodiments, the fusogen comprises one or more sequence alterations outside of the targeting moiety relative to the naturally-occurring form of the fusogen, e.g., in a transmembrane domain, fusogenically active domain, or cytoplasmic domain.

As used herein, a "targeted envelope protein" refers to a polypeptide that contains a henipavirus G protein (G protein) attached to a single domain antibody (sdAb) variable domain, such as a VL or VH sdAb, a scFv, a nanobody, a camelid VHH domain, a shark IgNAR, or fragments thereof, that target a molecule on a desired cell type. In some such embodiments, the attachment may be directly or indirectly via a linker, such as a peptide linker. The "targeted envelope protein" may also be referred to as a "fusion protein" comprising the G protein and antibodies or antigen binding fragments of the disclosure in which the antibody or antigen binding fragment is fused to the C-terminus of the G protein or a biologically active portion thereof.

As used herein, a "targeted lipid particle" refers to a lipid particle that contains a targeted envelope protein embedded in the lipid bilayer, e.g., targeting CD8. Such targeted lipid particles can be a viral particle, a virus-like particle, a nanoparticle, a vesicle, an exosome, a dendrimer, a lentivirus, a viral vector, an enucleated cell, a microvesicle, a membrane vesicle, an extracellular membrane vesicle, a plasma membrane vesicle, a giant plasma membrane vesicle, an apoptotic body, a mitoparticle, a pyrenocyte, a lysosome, another membrane enclosed vesicle, or a lentiviral vector, a viral based particle, a virus like particle (VLP), or a cell derived particle.

As used herein, a "retroviral nucleic acid" refers to a nucleic acid containing at least the minimal sequence requirements for packaging into a retrovirus or retroviral vector, alone or in combination with a helper cell, helper virus, or helper plasmid. In some embodiments, the retroviral nucleic acid further comprises or encodes an exogenous agent, a positive target cell-specific regulatory element, a non-target cell-specific regulatory element, or a negative TCSRE. In some embodiments, the retroviral nucleic acid comprises one or more of (e.g., all of) a 5' LTR (e.g., to promote integration), U3 (e.g., to activate viral genomic RNA transcription), R (e.g., a Tat-binding region), U5, a 3' LTR (e.g., to promote integration), a packaging site (e.g., psi ($\Psi$)), and RRE (e.g., to bind to Rev and promote nuclear export). The retroviral nucleic acid can comprise RNA (e.g., when part of a virion) or DNA (e.g., when being introduced into a source cell or after reverse transcription in a recipient cell). In some embodiments, the retroviral nucleic acid is packaged using a helper cell, helper virus, or helper plasmid which comprises one or more of (e.g., all of) gag, pol, and env.

As used herein, a "target cell" refers to a cell of a type to which it is desired that a targeted lipid particle delivers an exogenous agent. In embodiments, a target cell is a cell of a specific tissue type or class, e.g., an immune effector cell, e.g., a T cell. In some embodiments, a target cell is a diseased cell, e.g., a cancer cell. In some embodiments, the fusogen, e.g., a re-targeted fusogen, leads to preferential delivery of the exogenous agent to a target cell compared to a non-target cell.

As used herein a "non-target cell" refers to a cell of a type to which it is not desired that a targeted lipid particle delivers an exogenous agent. In some embodiments, a non-target cell is a cell of a specific tissue type or class. In some embodiments, a non-target cell is a non-diseased cell, e.g., a non-cancerous cell. In some embodiments, the fusogen, e.g., a re-targeted fusogen, leads to lower delivery of the exogenous agent to a non-target cell compared to a target cell.

The term "effective amount" as used herein means an amount of a pharmaceutical composition which is sufficient to significantly and positively modify the symptoms and/or conditions to be treated (e.g., provide a positive clinical response). The effective amount of the targeted lipid particles of the disclosure for use in a pharmaceutical composition will vary with the particular condition being treated, the severity of the condition, the duration of treatment, the nature of concurrent therapy, the particular lipid particle) being employed, the particular pharmaceutically-acceptable excipient(s) and/or carrier(s) utilized, and like factors with the knowledge and expertise of the attending physician. An "exogenous agent" as used herein with reference to a targeted lipid particle, refers to an agent that is neither comprised by nor encoded in the corresponding wild-type virus or fusogen made from a corresponding wild-type source cell. In some embodiments, the exogenous agent does not naturally exist, such as a protein or nucleic acid that has a sequence that is altered (e.g., by insertion, deletion, or substitution) relative to a naturally occurring protein. In some embodiments, the exogenous agent does not naturally exist in the source cell. In some embodiments, the exogenous agent exists naturally in the source cell but is exogenous to the virus. In some embodiments, the exogenous agent does not naturally exist in the recipient cell. In some embodiments, the exogenous agent exists naturally in the recipient cell, but is not present at a desired level or at a desired time. In some embodiments, the exogenous agent comprises DNA, RNA, or protein.

As used herein, a "promoter" refers to a cis-regulatory DNA sequence that, when operably linked to a gene coding sequence, drives transcription of the gene. The promoter may comprise one or more transcription factor binding sites. In some embodiments, a promoter works in concert with one or more enhancers which are distal to the gene.

As used herein, a composition refers to any mixture of two or more products, substances, or compounds, including cells. It may be a solution, a suspension, liquid, powder, a paste, aqueous, non-aqueous, or any combination thereof.

As used herein, the term "pharmaceutically acceptable" refers to a material, such as a carrier or diluent, which does not abrogate the biological activity or properties of a therapeutic compound, and is relatively nontoxic, i.e., the material may be administered to an individual without causing undesirable biological effects or interacting in a deleterious manner with any of the components of the composition in which it is contained.

As used herein, the term "pharmaceutical composition" refers to a mixture of at least one targeted lipid particle of the disclosure with other chemical components, such as carriers, stabilizers, diluents, dispersing agents, suspending agents, thickening agents, and/or excipients. The pharmaceutical composition facilitates administration of the targeted lipid particle to an organism. Multiple techniques of administering targeted lipid particles of the disclosure exist in the art including, but not limited to, intravenous, oral, aerosol, parenteral, ophthalmic, pulmonary, and topical administration.

A "disease" or "disorder" as used herein refers to a condition in which treatment is needed and/or desired.

As used herein, the terms "treat," "treating," or "treatment" refer to ameliorating a disease or disorder, e.g., slowing or arresting or reducing the development of the disease or disorder or reducing at least one of the clinical symptoms thereof. For purposes of this disclosure, ameliorating a disease or disorder can include obtaining a beneficial or desired clinical result that includes, but is not limited to, any one or more of: alleviation of one or more symptoms, diminishment of extent of disease, preventing or delaying spread (for example, metastasis, for example metastasis to the lung or to the lymph node) of disease, preventing or delaying recurrence of disease, delay or slowing of disease progression, amelioration of the disease state, inhibiting the disease or progression of the disease, inhibiting or slowing the disease or its progression, arresting its development, and remission (whether partial or total).

The terms "individual" and "subject" are used interchangeably herein to refer to an animal; for example a mammal. The terms include human and veterinary animals. In some embodiments, methods of treating animals, including, but not limited to, humans, rodents, simians, felines, canines, equines, bovines, porcines, ovines, caprines, mammalian laboratory animals, mammalian farm animals, mammalian sport animals, and mammalian pets, are provided. The animal can be male or female and can be any suitable age, including infant, juvenile, adolescent, adult, and geriatric. In some examples, an "individual" or "subject" refers to an animal in need of treatment for a disease or disorder. In some embodiments, the animal to receive the treatment can be a "patient," designating the fact that the animal has been identified as having a disorder of relevance to the treatment, or being at adequate risk of contracting the disorder. In particular embodiments, the animal is a human, such as a human patient.

CD8-Specific Antibodies

Described herein are novel antibodies and antigen binding fragments thereof that specifically target and bind CD8α or CD8β. In some embodiments, the antibodies or antigen binding fragments thereof may cross-react with cynomolgus (or "cyno") or *M. nemestrina* CD8. In some embodiments, the antibodies or antigen binding fragments thereof are single-chain variable fragments (scFvs) composed of the antigen-binding domains derived from the heavy (VH) and the light (VL) chains of the IgG molecule and connected via a linker domain. In some embodiments, the antibodies or antigen binding fragments thereof are VHHs that correspond to the VH of the IgG molecule. The present disclosure also provides polynucleotides encoding the antibodies and fragments thereof, vectors, and host cells, and methods of using the antibodies or antigen binding fragments thereof. In some embodiments, e.g., the antibodies or antigen binding fragments thereof may be fused to henipavirus glycoprotein G for targeted binding and transduction to cells.

Sequences for exemplary antibodies and antigen binding fragments of the disclosure using the Kabat numbering scheme are shown in Tables 3-4 below. Sequences for exemplary HCDRs of the disclosure are shown in Table 3. Sequences for exemplary LCDRs of the disclosure are shown in Table 4.

The sequences for the disclosed VH and VL domains are provided in Tables 5-6. Tables 8-11 provided herein show the CDR sequences of the disclosed antibodies and antigen binding fragments thereof using both Chothia and IMGT numbering schemes. The full CD8 binder sequences of the variant CD8 scFvs and VHHs of the disclosure are shown in Table 12.

TABLE 3

HCDRS in Kabat Numbering Scheme

| CD8 Binder | H-CDR1 Sequence | SEQ ID NO: | H-CDR2 Sequence | SEQ ID NO: | H-CDR3 Sequence | SEQ ID NO: |
|---|---|---|---|---|---|---|
| 1 | SYAIS | 1 | IIDPSDGNTNYAQNFQG | 70 | ERAAAGYYYYMDV | 148 |
| 2 | TYAIN | 2 | RIDPSSGGTKYAQNFQG | 71 | EHAAGTYYYYMDV | 149 |
| 3 | SYAIN | 3 | HDPSGGNTNYAQNFQG | 72 | ERAAAGYYYYMDV | 148 |
| 4 | GYYMH | 4 | HINPNNGDTNYAQNFQG | 73 | EGYYYYGMDV | 649 |
| 5 | DYYIQ | 5 | WINPNSGGTSYAQKFQG | 74 | EGDYYYGMDA | 150 |
| 6 | RYDIH | 6 | VINPNDGSTRYAQNFQG | 75 | ERGGMPDY | 151 |
| 7 | SYAMN | 7 | RINPNSGGTNYAQKFQG | 76 | GHGIPKY | 152 |
| 8 | SYYIH | 8 | WMNPNSGNTGYAQKFQG | 77 | VRSGSPQH | 153 |
| 9 | RHYIH | 9 | WMNPNSGNTGYAQKFQG | 77 | GGPWIVDAFDI | 154 |
| 10 | SYGIS | 10 | WISAHNGVTQYAQKFQG | 78 | GIAVAGTDY | 650 |
| 11 | NTDIN | 11 | IINPSGGSTSYAQKFQG | 79 | EATWGPYYYYMDV | 155 |
| 12 | RSYVH | 12 | WISPYNGNTKYAQKFQG | 80 | NKDGLQH | 156 |
| 13 | GYYMH | 13 | HNPNSGDTKYAHQFQG | 81 | DAKRVGYYYYMDV | 157 |
| 14 | RYYMH | 14 | RINPNSGGTNYAQKFQG | 76 | LVGGSPDY | 158 |
| 15 | NYDIN | 15 | RINPNSGGTNYAENFQG | 1057 | GAMVDY | 159 |
| 16 | NTDIN | 11 | HNPSDGDTKYAQEFQG | 82 | GNYVGSYYYGMDV | 160 |
| 17 | NYYLH | 16 | WINPNSGDTKYAQKFQG | 83 | DSRGDWYFDL | 161 |
| 18 | RYSIH | 17 | VIDPSGGSTSYAQKFQG | 84 | HGGRGLADY | 162 |
| 19 | SRDIS | 18 | WIDPKSGDTTYAQKFQG | 85 | LKELSSILDAFDI | 163 |
| 20 | SYDIN | 19 | MINPGAGSSTYAQKFQG | 86 | ERFGTGYYYYMDV | 164 |
| 21 | NSDMN | 20 | LISGDGGTTYYADSVKG | 87 | VIGEMVDDAFDL | 165 |
| 22 | GYYMH | 4 | SINPNSGDTGYAQKFQG | 88 | ERLFGTYYYYMDV | 166 |
| 23 | TYDIN | 21 | RHPIFGTANYAQKFQG | 89 | ADGELTDY | 167 |
| 24 | SYTMD | 22 | AIGTGGGIYYADSVKG | 90 | HHLPAHYYYYMDV | 168 |
| 25 | RYDIN | 23 | RINPNSGDTNYAQKFQG | 91 | DVPAGRYYYYMDV | 169 |
| 26 | SYYMH | 24 | MINPSDGSTRYAQKFQG | 92 | DRGVGRYYYYMDV | 170 |
| 27 | RYAVS | 25 | HNPSDGSTTYAQKFQG | 93 | DSRYGRYYYYMDV | 171 |
| 28 | NYAIS | 26 | HNPNGGSPSYAQKFQG | 94 | EIVVGPYYYYMDV | 172 |
| 29 | RYAIS | 617 | RINPNSGDTNYAQKFQG | 91 | GMVRGPYYYYMDV | 173 |
| 30 | SYAIS | 1 | IINPSGGSTSYAQTFQG | 1058 | EGVTGPYYYYMDV | 174 |
| 31 | RFDIN | 28 | HNPSDGSTDYAQNFQG | 95 | DAAAGTRYYYYGMDV | 175 |
| 32 | SHAIS | 29 | IINPSGGSTSYAQKFQG | 79 | ELYSSTYYYYMDV | 176 |
| 33 | SYAIS | 1 | RINPNTGGTNHAQKFQG | 96 | ALYSGPYYYYMDV | 177 |
| 34 | NSDMN | 20 | AISGSGGSTYYADSVKG | 97 | EHAAGTYYYYMDV | 149 |
| 35 | SYGIN | 30 | WISGYNGDTDYARKLQG | 98 | DSLVGRYYYYMDV | 178 |
| 36 | DYDIY | 31 | WISADNGNTNYEQKVQG | 99 | RSELDY | 179 |
| 37 | SYHMH | 32 | WISPNSGATHYAQKFQG | 100 | GDDNDY | 180 |

TABLE 3-continued

HCDRS in Kabat Numbering Scheme

| CD8 Binder | H-CDR1 Sequence | SEQ ID NO: | H-CDR2 Sequence | SEQ ID NO: | H-CDR3 Sequence | SEQ ID NO: |
|---|---|---|---|---|---|---|
| 38 | SYDIN | 19 | WINPNSGNTGYAKKFQG | 101 | GEEVDY | 181 |
| 39 | SYPMN | 33 | IINPSGGSTRYAQKFQG | 102 | GRRVPDY | 182 |
| 40 | DYYIH | 34 | WINPKSGATNYAQKFQG | 103 | GKVTTDY | 183 |
| 41 | SFEMN | 35 | RISESGDSSFYADSVKG | 104 | GRELIEY | 184 |
| 42 | DYAMH | 36 | AIGTGGGTYYADSVKG | 105 | VYDFPDV | 185 |
| 43 | DSYMH | 37 | WMNPSNGDTGYARKFQG | 106 | STYSHIDY | 186 |
| 44 | NYYMH | 38 | TISPSDGSTTYAQRFQG | 107 | EDSSGFDY | 187 |
| 45 | NYYIH | 39 | IINPSGGSTTYAQKFQG | 108 | DQGGGFDY | 188 |
| 46 | SYYMH | 40 | GFDPEDGETIYAQKFQG | 109 | DQGWGMDV | 189 |
| 47 | SYYIH | 8 | RINPKSGRTYYAQNFQG | 110 | LTEGIPDY | 190 |
| 48 | DYYIH | 41 | VINPGGGSTTYAQ.TFQG | 111 | DRYGPFDY | 191 |
| 49 | SYDIN | 19 | LMNPKTGDTNYAEKFQG | 112 | LVAGGAPDY | 192 |
| 50 | GYYMH | 4 | IIDPSDGYTSYAQKFQG | 113 | DGFTGDIAY | 193 |
| 51 | GYYMH | 4 | WINPNSGGTNYAQKFQG | 114 | VDDSSSPDY | 194 |
| 52 | GYYLH | 42 | GIMPISGTTIYAQKFQG | 115 | GPDGTEVDY | 195 |
| 52 | NHYMH | 43 | WMNPNSGNTGYAQKFQG | 77 | SESGSDLDY | 196 |
| 54 | NYYIH | 44 | WMSPTSGDTGYAQKFQG | 116 | EVEIEGYMDV | 197 |
| 55 | SYYMH | 40 | WINPNSGDTSYAQKFQG | 117 | DLDDDWYMDV | 198 |
| 56 | SYYMH | 40 | HDPSGDITSYAQKFQG | 118 | DSTTWDAFDI | 199 |
| 57 | DYYMH | 45 | WINPNSGGTNYAQKFQG | 114 | VLVGSGSPDY | 200 |
| 58 | ENEMH | 46 | IIETSGGSTDYAQKFQG | 119 | EAAAGLDFQH | 201 |
| 59 | SYDMH | 47 | HNPNSGGTNYAQKLQG | 120 | ANSWDADY | 202 |
| 60 | NSDMH | 48 | VISGSGVTTYYADSVKG | 121 | EHSSSWYTFDY | 203 |
| 61 | AYYMH | 49 | WINPNSGGTDYAQKFQG | 122 | DDDSSGYYLDY | 204 |
| 62 | NYYIH | 44 | MINPSGGSTTYAQKFQG | 123 | ASGDYMDLIDYMDY | 205 |
| 63 | DYHMH | 50 | WINPDSGGTNYEQKFQG | 124 | VGSSGYLAPTH | 206 |
| 64 | DYYMH | 51 | WMNPNSGNTGYAQKFQG | 77 | VRGDGYNLGDY | 207 |
| 65 | DYYMH | 52 | WINPNSGGTNSAQKFQG | 125 | DVDTAMGAGDY | 208 |
| 66 | DYYIH | 34 | IINPSGGSASYAQKFQG | 126 | VARWGYGDYPDY | 209 |
| 67 | THDIN | 53 | IISPSDGSTSYAQKLQG | 127 | DRNGDYYYGMDV | 210 |
| 68 | NYYIH | 54 | WINPISGGTHYAQKFQG | 128 | EGLGSSWYVLDY | 211 |
| 69 | SYDIN | 19 | WISADNGDTSFAQKFQG | 129 | DGSHYGYYGMDV | 212 |
| 70 | SYDIN | 19 | GISPIYGTPAYAQKFQG | 130 | PGPEGYYYGMDV | 213 |
| 71 | DNYMH | 55 | WMNPNSGNTGYAQKFQG | 77 | YHWDYGDYRFDY | 214 |
| 72 | SYYIH | 8 | WMNPNSGNTGYAQKFQG | 77 | VEIDYGDSPPDY | 215 |
| 73 | SYAIS | 56 | HNPSDGDTSYAQKFQG | 131 | GAEWELRYAFDI | 216 |

TABLE 3-continued

HCDRS in Kabat Numbering Scheme

| CD8 Binder | H-CDR1 Sequence | SEQ ID NO: | H-CDR2 Sequence | SEQ ID NO: | H-CDR3 Sequence | SEQ ID NO: |
|---|---|---|---|---|---|---|
| 74 | TYDIS | 57 | TINPSGGTTTYAQKFQG | 132 | ETYYGLYYYGMDV | 217 |
| 75 | SYDIN | 19 | WMNPKSGNTGYAQKFQG | 133 | APSLRGYSYGPDY | 218 |
| 76 | SYDIN | 58 | IINPSGGSTSYAQKFQG | 79 | DRQERYYYYMDV | 219 |
| 77 | SYDIN | 19 | HNPSDGSTDYAQKFQG | 1059 | DRSYGDYYYGMDV | 220 |
| 78 | SYDIN | 58 | IINPGGGNARHTQKFQG | 134 | EVFSENYYYYMDV | 221 |
| 79 | SYYMH | 40 | HNPSDGSTTYAQKFQG | 93 | EWDYTHYYYGMDV | 222 |
| 80 | SHWIH | 59 | GFDPEDGETVYAQNFQG | 135 | GDSSGYYQYYFDY | 223 |
| 81 | SYDIN | 19 | GITPVFGIANYAQKFQG | 136 | GSWDSSSWYIPEY | 224 |
| 82 | DYDIV | 60 | IINPRGGSTNYAQKFQG | 137 | LVWGGAYYYYMDV | 225 |
| 83 | SYGIS | 10 | WMNPNNGDTDYAQKFQG | 138 | PVFSGSYYWYFDP | 226 |
| 84 | SYDIN | 19 | HNPSGGGTSYAQKFQG | 139 | DQAVAGPYYYGMDV | 227 |
| 85 | SYAIS | 1 | LINPGSGNTNYAQKFQG | 140 | DRWLAGPYYYGMDV | 228 |
| 86 | GHDMH | 61 | GIIPIFGTPNYAQKFQG | 141 | VMGPVDYYYYGMDV | 229 |
| 87 | NYDMH | 62 | HNPSDGSTTYAQKFQG | 93 | DLGPFGSYYYYMDV | 230 |
| 88 | SYAMT | 63 | TINGDGDDTDYADSVKG | 142 | EGVVVPPYYYYMDV | 231 |
| 89 | TYYMH | 64 | QIDPNSGDTIYPQKFQG | 143 | SSGWSRYYYYYMDV | 232 |
| 90 | NYQIH | 65 | IINPSGGSTSYAQKFQG | 79 | DNGMTTGYYYYMDV | 233 |
| 91 | SYDIV | 66 | IINPSGGSTSYAQKFQG | 79 | DRAMVTGYYYGMDV | 234 |
| 92 | SYDIN | 19 | IVNPSDGNTNYAQKFQG | 144 | DRGYGDRGYYYGMDV | 235 |
| 93 | SYDIN | 67 | WINTYNGNTYYAQKLQG | 145 | SPKATADYYYYYMDV | 236 |
| 94 | SYDIN | 19 | IINPSDGITDYAQRFQG | 146 | STVTPSYYYYYGMDV | 237 |
| 95 | SHAIH | 68 | IINPRDGDTVYAQKFQG | 147 | EPVAGTGYYYYYGMDV | 238 |
| 96 | SYGIN | 69 | WMNPNSGNTGYAQKFQG | 77 | DNLAGFWSDYYYYGMDV | 239 |
| 97 | GYVMG | 1061 | AISRGGLSTSYADSVKG | 1062 | DRSDLYEITAASNIDS | 1063 |

TABLE 4

LCDRS in Kabat Numbering Scheme

| CD8 Binder | L-CDR1 Sequence | SEQ ID NO: | L-CDR2 Sequence | SEQ ID NO: | L-CDR3 Sequence | SEQ ID NO: |
|---|---|---|---|---|---|---|
| 1 | RASQSISSYLN | 240 | AASSLQS | 294 | QQSYSTPLT | 333 |
| 2 | QASQDISNYLN | 241 | AASSLQS | 294 | QQSYSNLVS | 334 |
| 3 | RASQSISSYLN | 240 | AASSLQS | 294 | QQSYSTPLT | 333 |
| 4 | RSSQSLLHSNGYNYLD | 242 | LGSNRAS | 295 | MQALQTPFT | 335 |
| 5 | RSSQSLLHSNGYNYLD | 242 | LGSNRAS | 295 | MQGLQTPHT | 336 |
| 6 | RASQSISRNLN | 243 | KASNLKG | 296 | QQTYSAPL | 337 |
| 7 | RSSQSLLHSNGYNYLD | 242 | LGSNRAS | 295 | MQTLQTPLT | 338 |

TABLE 4-continued

LCDRS in Kabat Numbering Scheme

| CD8 Binder | L-CDR1 Sequence | SEQ ID NO: | L-CDR2 Sequence | SEQ ID NO: | L-CDR3 Sequence | SEQ ID NO: |
|---|---|---|---|---|---|---|
| 8 | RASQSVSASDLA | 244 | GASTRAT | 297 | QQYGDSPGS | 339 |
| 9 | QASQDIGNYLN | 245 | AASTLQR | 298 | QQANSFPPT | 340 |
| 10 | RASQSISTHLA | 246 | GASTRAT | 297 | QQYGNSRT | 341 |
| 11 | RASQTISNYLN | 247 | AASTLQS | 299 | QQSYSTPPT | 342 |
| 12 | RASQGIRNDLG | 248 | DASTLQS | 300 | QQSYSSPYT | 343 |
| 13 | RASQSISNYLN | 249 | AASSLQS | 294 | QQSYSTPYT | 344 |
| 14 | RSSQSLLHSNGYNYLD | 242 | LGSNRAS | 295 | MQGAHWPPT | 345 |
| 15 | RASQGISDSLA | 250 | GASSLRS | 301 | QQSYRTPYT | 346 |
| 16 | RASQSISNYLN | 249 | AASSLQS | 294 | QESFTTQWT | 347 |
| 17 | QASQDIHNYLN | 251 | DASNLET | 302 | QQANSFPPT | 340 |
| 18 | QASQDISNYLN | 241 | SASSLQS | 303 | QQRSNWPLYT | 348 |
| 19 | RASQSISDWLA | 252 | AASSLQT | 304 | QQAISFPIT | 349 |
| 20 | QASQDISNYLN | 241 | SASTLQS | 305 | QQSYSSPFT | 350 |
| 21 | RASQSISTWLA | 253 | AASTLQS | 299 | QQAISFPLT | 351 |
| 22 | RASQSISNYLN | 249 | AASTLQS | 299 | QQSYTFPIT | 352 |
| 23 | RSSQSLLHSNGYNYLD | 242 | DASHLET | 306 | QQYYSYPPT | 353 |
| 24 | QASQDISNYLN | 241 | AASTLHS | 307 | QQSYSAPLT | 354 |
| 25 | QASQDISNYLN | 241 | AASTLQS | 299 | QQSFSTFYT | 355 |
| 26 | QASQDISNYLN | 241 | AASTLQS | 299 | QQSYSIPFT | 356 |
| 27 | RASQSINRFLN | 254 | AASSLQN | 308 | QQSYSTPYT | 344 |
| 28 | RASQSISSYLN | 240 | AASSLQS | 294 | QQSYSTPLT | 333 |
| 29 | QASQDISNYLN | 241 | AASTLQS | 299 | QQSYSTPIT | 357 |
| 30 | RASQSVSTYLN | 255 | AASSLQS | 294 | QQSYTIPST | 358 |
| 31 | QASQDIAKYLN | 256 | AASSLQS | 294 | QQSYSAPPT | 359 |
| 32 | QASQGITNYLN | 257 | GASSLQS | 309 | QQSYSTPWT | 360 |
| 33 | RASQSISSYLN | 240 | AASSLQS | 294 | QQSYSTPLT | 333 |
| 34 | QASQDIHNYLN | 251 | AASTLQS | 299 | QQSYTTPLT | 361 |
| 35 | QASQDISNYLN | 241 | SAFSLQS | 310 | QQSYSAPIT | 362 |
| 36 | RASQSISSYLN | 240 | SASNLQS | 311 | QQRSNWPPVT | 363 |
| 37 | QANQDISNFLE | 258 | DASSLES | 312 | QQSYSIPIT | 364 |
| 38 | RASQGISNNLN | 259 | EASTLES | 313 | QQSYSTPLT | 333 |
| 39 | RSSQSLLHSNGYNYLD | 242 | GASTLET | 314 | MQGLQPPGT | 365 |
| 40 | RASQSISRSLV | 260 | AASTLQT | 315 | QQSYNHFRT | 366 |
| 41 | QASQDISNYLN | 241 | DASNLET | 302 | QRSDSTPLT | 367 |
| 42 | QASHDISKSLN | 261 | GASTLQS | 316 | QQLNSYPRT | 368 |
| 43 | RASQDIGAYLA | 262 | AASSLQS | 294 | QQSYSIPYT | 369 |

TABLE 4-continued

LCDRS in Kabat Numbering Scheme

| CD8 Binder | L-CDR1 Sequence | SEQ ID NO: | L-CDR2 Sequence | SEQ ID NO: | L-CDR3 Sequence | SEQ ID NO: |
|---|---|---|---|---|---|---|
| 44 | RASQSISSYLA | 263 | AASSLQS | 294 | QQSYSTPYT | 344 |
| 45 | RASQGIRSYLA | 264 | GASNLET | 317 | QQSYSTPYT | 344 |
| 46 | RASQSISSYLN | 240 | AASSLQS | 294 | QQTYSTPYT | 370 |
| 47 | RASQNIGTWLA | 265 | AASTLQS | 299 | QQSYSTPQT | 371 |
| 48 | RASQTISYYLN | 266 | AASTLQS | 299 | QQSYRTPYT | 346 |
| 49 | RSSQSLLHSNGYNYLD | 242 | MGSNRAS | 318 | MQGTHWPT | 372 |
| 50 | RASQNINNYLN | 267 | GASSLQS | 309 | QQTFSLPYT | 373 |
| 51 | RASQTISTYLN | 268 | DASNLET | 302 | QQSYSTPYT | 344 |
| 52 | RASRGIGNDLA | 269 | DASTLET | 319 | QQGYNMPLT | 374 |
| 52 | RASQ.TIGNYVN | 270 | GASNLHT | 320 | QQTYSAPLT | 375 |
| 54 | RASQFIGSWLA | 271 | AASTLQS | 299 | QQSYSFPWT | 376 |
| 55 | RASQSISSWMA | 272 | DASNLET | 302 | QQTYSTPYI | 377 |
| 56 | RASQGISNNLN | 259 | DASNLET | 302 | QQSYSSPWT | 378 |
| 57 | KSSQSVLYSSNNKNYLA | 273 | WASTRES | 321 | QQYASAPRT | 379 |
| 58 | RASQSISSYLN | 240 | KTSSLES | 322 | QQSFTIPYT | 380 |
| 59 | RVSQGISSYLN | 274 | GASSLQS | 309 | QQSYSTPLT | 333 |
| 60 | RASQSISDWLA | 252 | DASNLET | 302 | QQSYSTPLT | 333 |
| 61 | RASQGISNYLA | 275 | SASNLQS | 311 | QQTYRTPPT | 381 |
| 62 | RASQSIRNYLT | 276 | SASNLQS | 311 | QQSYSTPLT | 333 |
| 63 | RASQNIRLYLN | 277 | AASTLQS | 299 | QQSLTTPFT | 382 |
| 64 | QASQDIRKFLN | 278 | AASSLQS | 294 | QQLNGYPGT | 383 |
| 65 | RASQSISSYLN | 240 | TASNLQS | 323 | QQSYSLPLT | 384 |
| 66 | QASQDISNYLS | 279 | DASNLQS | 324 | QQTYTTPRT | 385 |
| 67 | RASQNVRSWLA | 280 | AASSLQS | 294 | QQSYNTPYT | 386 |
| 68 | RASQGIGNDLG | 281 | AASSLQS | 294 | QQSYAPPPT | 387 |
| 69 | RASQSISNWLA | 282 | GASNLET | 317 | QQSYSTPPT | 342 |
| 70 | RSSQSLLHSNGYNYLD | 242 | LGSNRAS | 295 | MQGLQTPLT | 388 |
| 71 | RASQSISSYLN | 240 | LASSLQS | 325 | QQSDSIPVT | 389 |
| 72 | QASQDISNYLN | 241 | STSSLQS | 326 | QQSYSTPYN | 390 |
| 73 | RASESIGSWLA | 283 | AASSLQS | 294 | QQSYSTPYT | 344 |
| 74 | RASQSISNYLN | 249 | AASSLQR | 327 | QQSYSTPLT | 333 |
| 75 | RASQSVTSNYLA | 284 | GASTRAT | 297 | QHYGSSPA | 391 |
| 76 | RASQSISSYLN | 240 | AASSLQS | 294 | QQSYSTPLT | 333 |
| 77 | RASQGISSYLA | 285 | AASTLQS | 299 | QQSYSTPPT | 342 |
| 78 | RASQDIGNYLN | 286 | AASSLQS | 294 | QQAYTYPYT | 392 |
| 79 | QASQDISNYLN | 241 | GASSLQS | 309 | QQSYTTPNT | 393 |
| 80 | RASQGISNYLA | 275 | AASTLQS | 299 | QQSYSTPYT | 344 |

TABLE 4-continued

LCDRS in Kabat Numbering Scheme

| CD8 Binder | L-CDR1 Sequence | SEQ ID NO: | L-CDR2 Sequence | SEQ ID NO: | L-CDR3 Sequence | SEQ ID NO: |
|---|---|---|---|---|---|---|
| 81 | RASQGISNGLS | 287 | DASNLET | 302 | QQSYSTPFT | 394 |
| 82 | RASQNIRNYLN | 288 | GASSLQS | 309 | QQSYSTPLT | 333 |
| 83 | QASLDINNYLN | 289 | KASSLES | 328 | QQSYSMPLT | 395 |
| 84 | QASQDISNYLN | 241 | AASSLQG | 329 | QQSYTTPWT | 396 |
| 85 | QASQDISNYLN | 241 | AASSLQS | 294 | QQSYSSPLT | 397 |
| 86 | QASQDISNYLN | 241 | KASSLES | 328 | QQSYSDPLT | 398 |
| 87 | QASQDISNYLN | 241 | GASTLQS | 316 | QQSYSAPIT | 362 |
| 88 | RASQSISNYLN | 249 | AASNLQS | 330 | QQSYTTPLT | 361 |
| 89 | RASQNIGNYLN | 290 | AASTLQS | 299 | QQSYSTPPWT | 399 |
| 90 | QASQDISNYLN | 241 | AASTLRS | 331 | QQSYQTPLT | 400 |
| 91 | QASQDISNYLN | 241 | AASTLQS | 299 | QQSYTTPPT | 401 |
| 92 | QASQDISNYLN | 241 | AASSLHS | 332 | QQSYSTPQT | 371 |
| 93 | RASQGIRNDLN | 291 | AASNLQS | 330 | QQANSFPIT | 402 |
| 94 | RASQGINTWLA | 292 | AASSLQS | 294 | QQSYSTPYT | 344 |
| 95 | QASQDISNYLN | 241 | AASTLQS | 299 | QQSYTVPPT | 403 |
| 96 | RASQFIGSWLA | 293 | AASTLQS | 299 | QQDDSFPLT | 404 |

In some embodiments, an antibody or antigen binding fragment thereof capable of binding CD8α or CD8β is disclosed, comprising a heavy chain variable region and a light chain variable region, wherein the heavy chain variable region comprises three heavy chain complementarity determining regions (HCDR1, HCDR2, and HCDR3), and the light chain variable region comprises three light chain complementarity determining regions (LCDR1, LCDR2, and LCDR3). In some embodiments, the HCDR1, HCDR2, and HCDR3 comprise amino acid sequences of any one of the SEQ ID NOs recited in Tables 3, 8, and 10, and the LCDR1, LCDR2, and LCDR3 comprise amino acid sequences of any one of the SEQ ID NOs recited in Tables 3, 9, and 11. In some embodiments, the heavy chain variable region (VH) comprises an amino acid sequence of any one of SEQ ID NOs: 405-498 (Table 5) and the light chain variable region (VL) comprises an amino acid sequence of any one of SEQ ID NOs: 499-591 (Table 6).

In another embodiment, the antibody or antigen binding fragment thereof comprises a VH having an amino acid sequence with at least 90%, 95%, 96%, 97%, 98%, 99%, or 100% identity to a sequence selected from SEQ ID NOs: 405-498.

In another embodiment, the antibody or antigen binding fragment thereof comprises a VL having an amino acid sequence with at least 90%, 95%, 96%, 97%, 98%, 99%, or 100% identity to a sequence selected from SEQ ID NOs: 499-591.

In another embodiment, the antibody or antigen binding fragment comprises a VH having an amino acid sequence with at least 90%, 95%, 96%, 97%, 98%, 99%, or 100% identity to a sequence selected from SEQ ID NOs: 405-498 and a VL having an amino acid sequence with at least 90%, 95%, 96%, 97%, 98%, 99%, or 100% identity to a sequence selected from SEQ ID NOs: 499-591.

In another embodiment, the antibody or antigen binding fragment thereof comprises a VH having an amino acid sequence with at least 90%, 95%, 96%, 97%, 98%, 99%, or 100% identity to SEQ ID NO: 1060.

In another embodiment, the antibody or antigen binding fragment thereof comprises the VH of SEQ ID NO: 405 and the VL of SEQ ID NO: 499.

In another embodiment, the antibody or antigen binding fragment thereof comprises the VH of SEQ ID NO: 408 and the VL of SEQ ID NO: 503.

In another embodiment, the antibody or antigen binding fragment thereof comprises the VH of SEQ ID NO: 448 and the VL of SEQ ID NO: 542.

In another embodiment, the antibody or antigen binding fragment thereof comprises the VH of SEQ ID NO: 455 and the VL of SEQ ID NO: 549.

In another embodiment, the antibody or antigen binding fragment thereof comprises the VH of SEQ ID NO: 1060.

In another embodiment, the antibody or antigen binding fragment thereof comprises the HCDR1, HCDR2, HCDR3, LCDR1, LCDR2, and LCDR3 of SEQ ID NOs: 1, 70, 148, 240, 294, and 333, respectively.

In another embodiment, the antibody or antigen binding fragment thereof comprises the HCDR1, HCDR2, HCDR3, LCDR1, LCDR2, and LCDR3 of SEQ ID NOs: 5, 74, 150, 242, 295, and 336, respectively.

In another embodiment, the antibody or antigen binding fragment thereof comprises the HCDR1, HCDR2, HCDR3, LCDR1, LCDR2, and LCDR3 of SEQ ID NOs: 40, 109, 189, 240, 294, and 370, respectively.

In another embodiment, the antibody or antigen binding fragment thereof comprises the HCDR1, HCDR2, HCDR3, LCDR1, LCDR2, and LCDR3 of SEQ ID NOs: 43, 77, 196, 270, 320, and 375, respectively.

In another embodiment, the antibody or antigen binding fragment thereof comprises the HCDR1, HCDR2, and HCDR3 of SEQ ID NOs: 1061, 1062, and 1063, respectively.

In some embodiments, the single domain antibody can be human or humanized. In some embodiments, the single domain antibody or portion thereof is naturally occurring. In some embodiments, the single domain antibody or portion thereof is synthetic.

In some embodiments, the single domain antibodies are antibodies whose complementary determining regions are part of a single domain polypeptide. In some embodiments, the single domain antibody is a heavy chain only antibody variable domain. In some embodiments, the single domain antibody does not include light chains.

In various embodiments, any of the antibodies or antigen binding fragments described herein can comprise a heavy chain constant region and a light chain constant region. The heavy chain constant region may be an IgG, IgM, IgA, IgD, or IgE isotype, or a derivative or fragment thereof that retains at least one effector function of the intact heavy chain. The heavy chain constant region may be a human IgG isotype. The heavy chain constant region may be a human IgG1 or human IgG4 isotypes. The heavy chain constant region may be a human IgG1 isotype. The light chain constant region may be a human kappa light chain or lambda light chain or a derivative or fragment thereof that retains at least one effector function of the intact light chain. The light chain constant region may be a human kappa light chain.

In various embodiments, any of the disclosed antibodies or antigen binding fragments may be a rodent antibody or antigen binding fragment thereof, a chimeric antibody or an antigen binding fragment thereof, a CDR-grafted antibody or an antigen binding fragment thereof, or a humanized antibody or an antigen binding fragment thereof. In another embodiment, any of the disclosed antibodies or antigen binding fragments comprises human or human-derived heavy and light chain variable regions, including human frameworks or human frameworks with one or more back-mutations. In various embodiments, any of the disclosed antibodies or antigen binding fragments may be a Fab, Fab', F(ab')2, Fd, scFv, (scFv)2, scFv-Fc, VHH, or Fv fragment.

Antibodies whose heavy chain CDR, light chain CDR, VH, or VL amino acid sequences differ insubstantially from those shown in Tables 3-6 are encompassed within the scope of the disclosure. Typically, this involves one or more conservative amino acid substitutions with an amino acid having similar charge, hydrophobic, or stereo chemical characteristics in the antigen-binding site or in the framework without adversely altering the properties of the antibody. Conservative substitutions may also be made to improve antibody properties, for example stability or affinity. 1, 2, 3, 4, 5, 6, 7, 8, 9, 10, 11, 12, 13, 14, or 15 amino acid substitutions can be made to the VH or VL sequence. For example, a "conservative amino acid substitution" may involve a substitution of a native amino acid residue with a nonnative residue such that there is little or no effect on the polarity or charge of the amino acid residue at that position. Desired amino acid substitutions can be determined by those skilled in the art at the time such substitutions are desired. For example, amino acid substitutions can be used to identify important residues of the molecule sequence, or to increase or decrease the affinity of the molecules described herein. The following eight groups contain amino acids that are conservative amino acid substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M).

In some embodiments, the antibody or antigen binding fragment thereof binds to human CD8α or CD8β. In some embodiments, the antibody or antigen binding fragment thereof binds to a human CD8α homodimer composed of two α chains. In some embodiments, the antibody or antigen binding fragment thereof binds to a human CD8 heterodimer composed of one α chain and one β chain.

In some embodiments, the antibody or antigen binding fragment binding CD8 is a single-chain variable fragment. In embodiments involving a single polypeptide containing both a heavy chain variable region and a light chain variable region, both orientations of these variable regions are contemplated. In some cases, the heavy chain variable region is on the N-terminal side of the light chain variable region, which means the heavy chain variable region is closer to the N-terminus of the polypeptide. In other cases, the light chain variable region is on the N-terminal side of the heavy chain variable region, which means the light chain variable region is closer to the N-terminus of the polypeptide than the heavy chain variable region.

In some embodiments, the scFv binding proteins comprise a linker. In some embodiments, the linker is between the heavy chain variable region (VH) and the light chain variable region (VL) (or vice versa). In some embodiments, the linker comprises the amino acid sequence of GS, GGS, GGGS (SEQ ID NO: 645), GGGGS (SEQ ID NO: 627), GGGGGS (SEQ ID NO: 625), any one of SEQ ID NOs: 645-648, or combinations thereof. Substitutions to introduce new disulfide bonds are also within the scope of the disclosure, e.g., by making substitutions G44C in the VH FR 2 and G100C in the VL FR4.

In some embodiments, the anti-CD8 antibody or antigen binding fragment binds to human CD8 with an affinity constant ($K_D$) of between about 1 nM and about 900 nM. In some embodiments, the $K_D$ to human CD8 is between about 5 nM about 500 nM, about 6 nM to about 10 nM, about 11 nM to about 20 nM, about 25 nM to about 40 nM, about 40 nM to about 60 nM, about 70 nM to about 90 nM, about 100 nM to about 120 nM, about 125 nM to about 140 nM, about 145 nM to about 160 nM, about 170 nM and to about 200 nM, about 210 nM to about 250 nM, about 260 nM to about 300 nM, about 310 nM to about 350 nM, about 360 nM to about 400 nM, about 410 nM to about 450 nM, and about 460 nM to about 500 nM. In some embodiments, the anti-CD8 antibody or antigen binding fragment binds to human CD8 with an affinity constant ($K_D$) of 500 nM, 400 nM, 300 nM, 200 nM, 100 nM, 50 nM, 20 nM, or 10 nM or lower. In some embodiments, the anti-CD8 antibody or antigen binding fragment binds to human CD8 and cynomolgus, *M. mulatta* (rhesus monkey), or *M. nemestrina* CD8 with comparable binding affinity ($K_D$).

In some embodiments, the anti-CD8 antibody or antigen binding fragment binds to cynomolgus, *M. mulatta* (rhesus monkey), or *N. nemestrina* CD8. In some embodiments, the anti-CD8 antibody or antigen binding binds to mouse, dog, pig, etc., CD8. In some embodiments, the $K_D$ to cynomolgus or *M. nemestrina* CD8 is between about 5 nM about 500 nM, about 6 nM to about 10 nM, about 11 nM to about 20 nM, about 25 nM to about 40 nM, about 40 nM to about 60 nM, about 70 nM to about 90 nM, about 100 nM to about 120 nM, about 125 nM to about 140 nM, about 145 nM to about 160 nM, about 170 nM and to about 200 nM, about 210 nM to about 250 nM, about 260 nM to about 300 nM, about 310 nM to about 350 nM, about 360 nM to about 400 nM, about 410 nM to about 450 nM, and about 460 nM to about 500 nM. In some embodiments, the anti-CD8 antibody or antigen binding fragment binds to cynomolgus or *M. nemestrina* CD8 with an affinity constant ($K_D$) of 500 nM, 400 nM, 300 nM, 200 nM, 100 nM, 50 nM, 20 nM, or 10 nM or lower.

An antibody or antigen binding fragment thereof that specifically binds CD8α or CD8β refers to an antibody or binding fragment that preferentially binds to CD8α or CD8β, respectively, over other antigen targets. As used herein, the term is interchangeable with an "anti-CD8" antibody or an "antibody that binds CD8." In some embodiments, the antibody or binding fragment capable of binding to CD8α or CD8β can do so with higher affinity for that antigen than others. In some embodiments, the antibody or binding fragment capable of binding CD8α or CD8β can bind to that antigen with a $K_D$ of at least about $10^{-1}$, $10^{-2}$, $10^{-3}$, $10^{-4}$, $10^{-5}$, $10^{-6}$, $10^{-7}$, $10^{-8}$, $10^{-9}$, $10^{10}$, $10^{-11}$, $10^{-12}$ or greater (or any value in between), e.g., as measured by surface plasmon resonance or other methods known to those skilled in the art.

Another embodiment of the disclosure is an isolated polynucleotide encoding any of the antibody heavy chain variable regions or the antibody light chain variable regions of the disclosure. Certain exemplary polynucleotides are disclosed herein, however, other polynucleotides which, given the degeneracy of the genetic code or codon preferences in a given expression system, encode the antibodies or antigen binding fragments thereof of the disclosure are also within the scope of the disclosure. The polynucleotide sequences encoding a VH or a VL or a fragment thereof of the antibody or antigen binding fragments thereof of the disclosure can be operably linked to one or more regulatory elements, such as a promoter and enhancer, that allow expression of the nucleotide sequence in the intended host cell. The polynucleotide may be a cDNA.

Another embodiment of the disclosure is a vector comprising the polynucleotide of the disclosure. Such vectors may be plasmid vectors, viral vectors, vectors for baculovirus expression, transposon-based vectors, or any other vector suitable for introduction of the polynucleotide of the disclosure into a given organism or genetic background by any means. For example, polynucleotides encoding light and heavy chain variable regions of the antibodies of the disclosure, optionally linked to constant regions, may be inserted into expression vectors. The light and heavy chains can be cloned in the same or different expression vectors. The DNA segments encoding immunoglobulin chains may be operably linked to control sequences in the expression vector(s) that ensure the expression of immunoglobulin polypeptides. Such control sequences include signal sequences, promoters (e.g., naturally associated or heterologous promoters), enhancer elements, and transcription termination sequences, and are chosen to be compatible with the host cell chosen to express the antibody. Once the vector has been incorporated into the appropriate host, the host is maintained under conditions suitable for high level expression of the proteins encoded by the incorporated polynucleotides.

Suitable expression vectors are typically replicable in the host organisms either as episomes or as an integral part of the host chromosomal DNA. Commonly, expression vectors contain selection markers such as ampicillin-resistance, hygromycin-resistance, tetracycline resistance, kanamycin resistance, or neomycin resistance to permit detection of those cells transformed with the desired DNA sequences. Suitable vectors, promoter, and enhancer elements are known in the art; many are commercially available for generating subject recombinant constructs.

Another embodiment of the disclosure is a host cell comprising the vector of the disclosure. The term "host cell" refers to a cell into which a vector has been introduced. It is understood that the term host cell is intended to refer not only to the particular subject cell but to the progeny of such a cell. Because certain modifications may occur in succeeding generations due to either mutation or environmental influences, such progeny may not be identical to the parent cell, but are still included within the scope of the term "host cell" as used herein. Such host cells may be eukaryotic cells, prokaryotic cells, plant cells, or archeal cells. *Escherichia coli*, bacilli, such as *Bacillus subtilis*, and other enterobacteriaceae, such as *Salmonella, Serratia*, and various *Pseudomonas* species are examples of prokaryotic host cells. Other microbes, such as yeast, are also useful for expression. *Saccharomyces* (e.g., *S. cerevisiae*) and *Pichia* are examples of suitable yeast host cells. Exemplary eukaryotic cells may be of mammalian, insect, avian, or other animal origins.

Fusion Proteins Targeting CD8

Also provided herein are fusion proteins targeting CD8 that may be exposed on the surface on a lipid particle or viral vector. In some embodiments, the CD8 binders disclosed herein may be fused to an envelope glycoprotein G, H, and/or an F protein of the Paramyxoviridae family. In some embodiments the fusogen contains a Nipah virus protein F, a measles virus F protein, a tupaia paramyxovirus F protein, a paramyxovirus F protein, a Hendra virus F protein, a Henipavirus F protein, a Morbilivirus F protein, a respirovirus F protein, a Sendai virus F protein, a rubulavirus F protein, or an avulavirus F protein. In some embodiments, the lipid particle contains a henipavirus envelope attachment glycoprotein G (G protein) or a biologically active portion thereof and/or a henipavirus envelope fusion glycoprotein F (F protein) or a biologically active portion thereof.

In particular embodiments, the fusogen is glycoprotein GP64 of baculovirus, or glycoprotein GP64 variant E45K/T259A.

In some embodiments, the fusogen is a hemagglutinin-neuraminidase (HN) and/or fusion (F) protein (F/HN) from a respiratory paramyxovirus. In some embodiments, the respiratory paramyxovirus is a Sendai virus. The HN and F glycoproteins of Sendai viruses function to attach to sialic acids via the HN protein, and to mediate cell fusion for entry into cells via the F protein. In some embodiments, the fusogen is a F and/or HN protein from the murine parainfluenza virus type 1 (See e.g., U.S. patent Ser. No. 10/704,061).

In some embodiments, the lipid particle (e.g. viral vector) is psedutoptyed with viral glycoproteins as described herein such as a NiV-F and/or NiV-G protein.

In some embodiments, the viral vector further comprises a vector-surface targeting moiety which specifically binds to a target ligand. In some embodiments, the vector-surface targeting moiety is a polypeptide. In some embodiments, a nucleic acid encoding the Paramyxovirus envelope protein (e.g. G protein) is modified with a targeting moiety to specifically bind to a target molecule on a target cells. In some embodiments, the targeting moiety can be any targeting protein, including but not necessarily limited to antibodies and antigen binding fragments thereof.

It has been reported that the henipavirus F proteins from various species exhibit compatibility with G proteins from other species to trigger fusion (Brandel-Tretheway et al. Journal of Virology. 2019. 93(13):e00577-19). In some aspects of the provided lipid particles (e.g. lentiviral vectors), the F protein is heterologous to the G protein, i.e. the F and G proteins or biologically active portions thereof are from different henipavirus species. For example, in some embodiments the G protein is from Hendra virus and the F protein is a NiV-F as described. In other aspects, the F and/or G protein are chimeric F and/or G protein containing regions of F and/or G proteins from different species of Henipavirus. In some embodiments, replacing a portion of the F protein with amino acids from a heterologous sequence of Henipavirus results in fusion to the G protein with the heterologous sequence. (Brandel-Tretheway et al. 2019). In some cases, the chimeric F and/or G protein contains an extracellular domain from one henipavirus species and a transmembrane and/or cytoplasmic domain from a different henipavirus species. For example, in some embodiments the F protein contains an extracellular domain of Hendra virus and a transmembrane/cytoplasmic domain of Nipah virus.

In some embodiments, the fusion protein contains a henipavirus envelope attachment glycoprotein G (G protein) or a biologically active portion thereof and a single domain antibody (sdAb) variable domain or a single chain variable fragment (scFv). The sdAb variable domain or scFv can be linked directly or indirectly to the G protein. In particular embodiments, the sdAb variable domain or scFv is linked to the C-terminus (C-terminal amino acid) of the G protein or the biologically active portion thereof. The linkage can be via a peptide linker, such as a flexible peptide linker. Table 7 provides a list of non-limiting examples of G proteins. Exemplary full length fusion protein sequences of the disclosure are disclosed in Table 13.

In some embodiments the G protein is a Henipavirus G protein or a biologically active portion thereof. In some embodiments, the Henipavirus G protein is a Hendra (HeV) virus G protein, a Nipah (NiV) virus G-protein (NiV-G), a Cedar (CedPV) virus G-protein, a Mojiang virus G-protein, a bat Paramyxovirus G-protein, or a biologically active portion thereof. Non-limiting examples of G proteins include those corresponding to SEQ ID NOs: 609, 618, 619, 620, and 621.

In some embodiments, the attachment G proteins are type II transmembrane glycoproteins containing an N-terminal cytoplasmic tail (e.g., corresponding to amino acids 1-49 of SEQ ID NO: 600), a transmembrane domain (e.g., corresponding to amino acids 50-70 of SEQ ID NO: 600), and an extracellular domain containing an extracellular stalk (e.g., corresponding to amino acids 71-187 of SEQ ID NO: 600), and a globular head (corresponding to amino acids 188-602 of SEQ ID NO: 600). In such embodiments, the N-terminal cytoplasmic domain is within the inner lumen of the lipid bilayer and the C-terminal portion is the extracellular domain that is exposed on the outside of the lipid bilayer. Regions of the stalk in the C-terminal region (e.g. corresponding to amino acids 159-167 of NiV-G) have been shown to be involved in interactions with F protein and triggering of F protein fusion (Liu et al. 2015 J of Virology 89:1838). In wild-type G protein, the globular head mediates receptor binding to henipavirus entry receptors eprhin B2 and ephrin B3, but is dispensable for membrane fusion (Brandel-Tretheway et al. Journal of Virology. 2019. 93(13) e00577-19). In particular embodiments herein, tropism of the G protein is altered by linkage of the G protein or biologically active fragment thereof (e.g. cytoplasmic truncation) to a sdAb variable domain. Binding of the G protein to a binding partner can trigger fusion mediated by a compatible F protein or a biologically active portion thereof. G protein sequences disclosed herein are predominantly disclosed as expressed sequences including an N-terminal methionine required for start of translation. As such N-terminal methionines are commonly cleaved co- or post-translationally, the mature protein sequences for all G protein sequences disclosed herein are also contemplated as lacking the N-terminal methionine.

G glycoproteins are highly conserved among henipavirus species. For example, the G proteins of NiV and HeV viruses share 79% amino acid identity. Studies have shown a high degree of compatibility among G proteins with F proteins of different species as demonstrated by heterotypic fusion activation (Brandel-Tretheway et al. Journal of Virology. 2019). As described further below, a targeted lipid particle can contain heterologous G and F proteins from different species.

In some embodiments, the G protein has a sequence set forth in any of SEQ ID NOs: 600, 609, 618, 619, 620, 621, 628, 636, or 638-640, or is a functionally active variant or biologically active portion thereof that has a sequence that is at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% identical to any one of SEQ ID NOs: 600, 609, 618, 619, 620, 621, 628, 636, or 638-640. In particular embodiments, the G protein or functionally active variant or biologically active portion is a protein that retains fusogenic activity in conjunction with a Henipavirus F protein, such as an F protein (e.g. NiV-F or HeV-F). Fusogenic activity includes the activity of the G protein in conjunction with a Henipavirus F protein to promote or facilitate fusion of two membrane lumens, such as the lumen of the targeted lipid particle having embedded in its lipid bilayer a henipavirus F and G protein, and a cytoplasm of a target cell, e.g. a cell that contains a surface receptor or molecule that is recognized or bound by the targeted envelope protein. In some embodiments, the F protein and G protein are from the same Henipavirus species (e.g. NiV-G and NiV-F). In some embodiments, the F protein and G protein are from different Henipavirus species (e.g. NiV-G and HeV-F).

In particular embodiments, the G protein has the sequence of amino acids set forth in SEQ ID NOs: 600, 609, 618, 619, 620, 621, 628, 636, or 638-640, or is a functionally active variant thereof or a biologically active portion thereof that retains fusogenic activity. In some embodiments, the functionally active variant comprises an amino acid sequence having at least at or about 80%, at least at or about 85%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to any one of SEQ ID NOs: 600, 609, 618, 619, 620, 621, 628, 636, or 638-640 and retains fusogenic activity in conjunction with a Henipavirus F protein (e.g., NiV-F or HeV-F). In some embodiments, the biologically active portion has an amino acid sequence having at least at or about 80%, at least at or about 85%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to any one of SEQ ID NOs: 600, 609, 618, 619, 620, 621, 628, 636, or 638-640 and retains fusogenic activity in conjunction with a Henipavirus F protein (e.g., NiV-F or HeV-F).

Reference to retaining fusogenic activity includes activity (in conjunction with a Henipavirus F protein) that is at or about 10% to at or about 150% or more of the level or degree of binding of the corresponding wild-type G protein, such as set forth in any one of SEQ ID NOs: 600, 609, 618, 619, 620, 621, 628, 636, or 638-640, such as at least or at least about 10% of the level or degree of fusogenic activity of the corresponding wild-type G protein, such as at least or at least about 15% of the level or degree of fusogenic activity of the corresponding wild-type G protein, such as at least or at least about 20% of the level or degree of fusogenic activity of the corresponding wild-type G protein, such as at least or at least about 25% of the level or degree of fusogenic activity of the corresponding wild-type G protein, such as at least or at least about 30% of the level or degree of fusogenic activity of the corresponding wild-type G protein, such as at least or at least about 35% of the level or degree of fusogenic activity of the corresponding wild-type G protein, such as at least or at least about 40% of the level or degree of fusogenic activity of the corresponding wild-type G protein, such as at least or at least about 45% of the level or degree of fusogenic activity of the corresponding wild-type G protein, such as at least or at least about 50% of the level or degree of fusogenic activity of the corresponding wild-type G protein, such as at least or at least about 55% of the level or degree of fusogenic activity of the corresponding wild-type G protein, such as at least or at least about 60% of the level or degree of fusogenic activity of the corresponding wild-type G protein, such as at least or at least about 65% of the level or degree of fusogenic activity of the corresponding wild-type G protein, such as at least or at least about 70% of the level or degree of fusogenic activity of the corresponding wild-type G protein, such as at least or at least about 75% of the level or degree of fusogenic activity of the corresponding wild-type G protein, such as at least or at least about 80% of the level or degree of fusogenic activity of the corresponding wild-type G protein, such as at least or at least about 85% of the level or degree of fusogenic activity of the corresponding wild-type G protein, such as at least or at least about 90% of the level or degree of fusogenic activity of the corresponding wild-type G protein, such as at least or at least about 95% of the level or degree of fusogenic activity of the corresponding wild-type G protein, such as at least or at least about 100% of the level or degree of fusogenic activity of the corresponding wild-type G protein, or such as at least or at least about 120% of the level or degree of fusogenic activity of the corresponding wild-type G protein.

In some embodiments, the G protein is a mutant G protein that is a functionally active variant or biologically active portion containing one or more amino acid mutations, such as one or more amino acid insertions, deletions, substitutions, or truncations. In some embodiments, the mutations described herein relate to amino acid insertions, deletions, substitutions, or truncations of amino acids compared to a reference G protein sequence. In some embodiments, the reference G protein sequence is the wild-type sequence of a G protein or a biologically active portion thereof. In some embodiments, the functionally active variant or the biologically active portion thereof is a mutant of a wild-type Hendra (HeV) virus G protein, a wild-type Nipah (NiV) virus G-protein (NiV-G), a wild-type Cedar (CedPV) virus G-protein, a wild-type Mojiang virus G-protein, a wild-type bat Paramyxovirus G-protein, or biologically active portions thereof. In some embodiments, the wild-type G protein has the sequence set forth in any one of SEQ ID NOs: 600, 609, 618, 619, 620, 621, 628, 636, or 638-640.

In some embodiments, the G protein is a mutant G protein that is a biologically active portion that is an N-terminally and/or C-terminally truncated fragment of a wild-type Hendra (HeV) virus G protein, a wild-type Nipah (NiV) virus G-protein (NiV-G), a wild-type Cedar (CedPV) virus G-protein, a wild-type Mojiang virus G-protein, or a wild-type bat Paramyxovirus G-protein. In particular embodiments, the truncation is an N-terminal truncation of all or a portion of the cytoplasmic domain. In some embodiments, the mutant G protein is a biologically active portion that is truncated and lacks up to 49 contiguous amino acid residues at or near the N-terminus of the wild-type G protein, such as a wild-type G protein set forth in any one of SEQ ID NOs: 600, 609, 618, 619, 620, 621, 628, 636, or 638-640. In some embodiments, the mutant G protein is truncated and lacks up to 49 contiguous amino acids, such as up to 49, 48, 47, 46, 45, 44, 43, 42, 41, 40, 30, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2 or 1 contiguous amino acid(s) at the N-terminus of the wild-type G protein.

In some embodiments, the G protein is a wild-type Nipah virus G (NiV-G) protein or a Hendra virus G protein, or is a functionally active variant or biologically active portion thereof. In some embodiments, the G protein is a NiV-G protein that has the sequence set forth in SEQ ID NO:600, SEQ ID NO:618, or SEQ ID NO:628, or is a functional variant or a biologically active portion thereof that has an amino acid sequence having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:600, SEQ ID NO:618, or SEQ ID NO:628.

In some embodiments, the G protein is a mutant NiV-G protein that is a biologically active portion of a wild-type NiV-G. In some embodiments, the biologically active portion is an N-terminally truncated fragment. In some embodiments, the mutant NiV-G protein is truncated and lacks up to 5 contiguous amino acid residues at or near the N-terminus of the wild-type NiV-G protein (SEQ ID NO:600, SEQ ID NO:618, or SEQ ID NO:628), up to 6 contiguous amino acid residues at or near the N-terminus of the wild-type NiV-G protein (SEQ ID NO:600, SEQ ID NO:618, or SEQ ID NO:628), up to 7 contiguous amino acid residues at or near the N-terminus of the wild-type NiV-G protein (SEQ ID NO:600, SEQ ID NO:618, or SEQ ID NO:628), up to 8 contiguous amino acid residues at or near the N-terminus of the wild-type NiV-G protein (SEQ ID NO:600, SEQ ID NO:618, or SEQ ID NO:628), up to 9 contiguous amino acid residues at or near the N-terminus of the wild-type NiV-G protein (SEQ ID NO:600, SEQ ID NO:618, or SEQ ID NO:628), up to 10 contiguous amino acid residues at or near the N-terminus of the wild-type NiV-G protein (SEQ ID NO:600, SEQ ID NO:618, or SEQ ID NO:628), up to 11 contiguous amino acid residues at or near the N-terminus of the wild-type NiV-G protein (SEQ ID NO:600, SEQ ID NO:618, or SEQ ID NO:628), up to 12 contiguous amino acid residues at or near the N-terminus of the wild-type NiV-G protein (SEQ ID NO:600, SEQ ID NO:618, or SEQ ID NO:628), up to 13 contiguous amino acid residues at or near the N-terminus of the wild-type NiV-G protein (SEQ ID NO:600, SEQ ID NO:618, or SEQ ID NO:628), up to 14 contiguous amino acid residues at or near the N-terminus of the wild-type NiV-G protein (SEQ ID NO:600, SEQ ID NO:618, or SEQ ID NO:628), up to 15 contiguous amino acid residues at or near the N-terminus of the wild-type NiV-G protein (SEQ ID NO:600, SEQ ID NO:618, or SEQ ID NO:628), up to 16 contiguous amino acid residues at or near the N-terminus of the wild-type NiV-G protein (SEQ ID NO:600, SEQ ID NO:618, or SEQ ID NO:628), up to 17 contiguous amino acid residues at or near the N-terminus of the wild-type NiV-G protein (SEQ ID NO:600, SEQ ID NO:618, or SEQ ID NO:628), up to 18 contiguous amino acid residues at or near the N-terminus of the wild-type NiV-G protein (SEQ ID NO:600, SEQ ID NO:618, or SEQ ID NO:628), up to 19 contiguous amino acid residues at or near the N-terminus of the wild-type NiV-G protein (SEQ ID NO:600, SEQ ID NO:618, or SEQ ID NO:628), up to 20 contiguous amino acid residues at or near the N-terminus of the wild-type NiV-G protein (SEQ ID NO:600, SEQ ID NO:618, or SEQ ID NO:628), up to 21 contiguous amino acid residues at or near the N-terminus of the wild-type NiV-G protein (SEQ ID NO:600, SEQ ID NO:618, or SEQ ID NO:628), up to 22 contiguous amino acid residues at or near the N-terminus of the wild-type NiV-G protein (SEQ ID NO:600, SEQ ID NO:618, or SEQ ID NO:628), up to 23 contiguous amino acid residues at or near the N-terminus of the wild-type NiV-G protein (SEQ ID NO:600, SEQ ID NO:618, or SEQ ID NO:628), up to 24 contiguous amino acid residues at or near the N-terminus of the wild-type NiV-G protein (SEQ ID NO:600, SEQ ID NO:618, or SEQ ID NO:628), up to 25 contiguous amino acid residues at or near the N-terminus of the wild-type NiV-G protein (SEQ ID NO:600, SEQ ID NO:618, or SEQ ID NO:628), up to 26 contiguous amino acid residues at or near the N-terminus of the wild-type NiV-G protein (SEQ ID NO:600, SEQ ID NO:618, or SEQ ID NO:628), up to 27 contiguous amino acid residues at or near the N-terminus of the wild-type NiV-G protein (SEQ ID NO:600, SEQ ID NO:618, or SEQ ID NO:628), up to 28 contiguous amino acid residues at or near the N-terminus of the wild-type NiV-G protein (SEQ ID NO:600, SEQ ID NO:618, or SEQ ID NO:628), up to 29 contiguous amino acid residues at or near the N-terminus of the wild-type NiV-G protein (SEQ ID NO:600, SEQ ID NO:618, or SEQ ID NO:628), up to 30 contiguous amino acid residues at or near the N-terminus of the wild-type NiV-G protein (SEQ ID NO:600, SEQ ID NO:618, or SEQ ID NO:628), up to 31 contiguous amino acid residues at or near the N-terminus of the wild-type NiV-G protein (SEQ ID NO:600, SEQ ID NO:618, or SEQ ID NO:628), up to 32 contiguous amino acid residues at or near the N-terminus of the wild-type NiV-G protein (SEQ ID NO:600, SEQ ID NO:618, or SEQ ID NO:628), up to 33 contiguous amino acid residues at or near the N-terminus of the wild-type NiV-G protein (SEQ ID NO:600, SEQ ID NO:618, or SEQ ID NO:628), up to 34 contiguous amino acid residues at or near the N-terminus of the wild-type NiV-G protein (SEQ ID NO:600, SEQ ID NO:618, or SEQ ID NO:628), up to 35 contiguous amino acid residues at or near the N-terminus of the wild-type NiV-G protein (SEQ ID NO:600, SEQ ID NO:618, or SEQ ID NO:628), up to 36 contiguous amino acid residues at or near the N-terminus of the wild-type NiV-G protein (SEQ ID NO:600, SEQ ID NO:618, or SEQ ID NO:628), up to 37 contiguous amino acid residues at or near the N-terminus of the wild-type NiV-G protein (SEQ ID NO:600, SEQ ID NO:618, or SEQ ID NO:628), up to 38 contiguous amino acid residues at or near the N-terminus of the wild-type NiV-G protein (SEQ ID NO:600, SEQ ID NO:618, or SEQ ID NO:628), up to 39 contiguous amino acid residues at or near the N-terminus of the wild-type NiV-G protein (SEQ ID NO:600, SEQ ID NO:618, or SEQ ID NO:628), up to 40 contiguous amino acid residues at or near the N-terminus of the wild-type NiV-G protein (SEQ ID NO:600, SEQ ID NO:618, or SEQ ID NO:628), up to 41 contiguous amino acid residues at or near the N-terminus of the wild-type NiV-G protein (SEQ ID NO:600, SEQ ID NO:618, or SEQ ID NO:628), up to 42 contiguous amino acid residues at or near the N-terminus of the wild-type NiV-G protein (SEQ ID NO:600, SEQ ID NO:618, or SEQ ID NO:628), up to 43 contiguous amino acid residues at or near the N-terminus of the wild-type NiV-G protein (SEQ ID NO:600, SEQ ID NO:618, or SEQ ID NO:628), up to 44 contiguous amino acid residues at or near the N-terminus of the wild-type NiV-G protein (SEQ ID NO:600, SEQ ID NO: 618, or SEQ ID NO: 628), or up to 45 contiguous amino acid residues at or near the N-terminus of the wild-type NiV-G protein (SEQ ID NO:600, SEQ ID NO:618, or SEQ ID NO:628).

In some embodiments, the NiV-G protein is a biologically active portion that does not contain a cytoplasmic domain. In some embodiments, the NiV-G protein without the cytoplasmic domain is encoded by SEQ ID NO:622.

In some embodiments, the mutant NiV-G protein comprises a sequence set forth in any of SEQ ID NOs: 601-606, 629-634, 612, 622, or 637, or is a functional variant thereof that has an amino acid sequence having at least at or about 80%, at least at or about 81%, at least at or about 82%, at least at or about 83%, at least at or about 84%, at least at or about 85%, at least at or about 86%, or at least at or about 87%, at least at or about 88%, or at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NOs: 601-606, 629-634, 612, 622, or 637.

In some embodiments, the mutant NiV-G protein has a 5 amino acid truncation at or near the N-terminus of the wild-type NiV-G protein (SEQ ID NO:600, SEQ ID NO:618, or SEQ ID NO:628), such as set forth in SEQ ID NO:601 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:601, or as set forth in SEQ ID NO:629 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:629 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:629.

In some embodiments, the mutant NiV-G protein has a 10 amino acid truncation at or near the N-terminus of the wild-type NiV-G protein (SEQ ID NO:600, SEQ ID NO:618, or SEQ ID NO:628), such as set forth in SEQ ID NO:602 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:602, or such as set forth in SEQ ID NO:630 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at or about 96%, at least at or about 97%, at least at or about 98%, or at least at or about 99% sequence identity to SEQ ID NO:630.

In some embodiments, the mutant NiV-G protein has a 15 amino acid truncation at or near the N-terminus of the wild-type NiV-G protein (SEQ ID NO:600, SEQ ID NO:618, or SEQ ID NO:628), such as set forth in SEQ ID NO:603 or a functional variant thereof that has an amino acid sequence having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:603, or such as set forth in SEQ ID NO:631 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:631.

In some embodiments, the mutant NiV-G protein has a 20 amino acid truncation at or near the N-terminus of the wild-type NiV-G protein (SEQ ID NO:600, SEQ ID NO:618, or SEQ ID NO:628) such as set forth in SEQ ID NO:604, or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least or about 96%, at least at or about 97%, at least at or about 98%, or at least at or about 99% sequence identity to SEQ ID NO:604, or such as set forth in SEQ ID NO:632 or a functional variant thereof having at least at or about 80%, at least at or about 81%, at least at or about 82%, at least at or about 83%, at least or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:632.

In some embodiments, the mutant NiV-G protein has a 25 amino acid truncation at or near the N-terminus of the wild-type NiV-G protein (SEQ ID NO:600, SEQ ID NO:618, or SEQ ID NO:628), such as set forth in SEQ ID NO:605 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least or about 96%, at least at or about 97%, at least at or about 98%, or at least at or about 99% sequence identity to SEQ ID NO:605, or such as set forth in SEQ ID NO:633 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:633.

In some embodiments, the mutant NiV-G protein has a 30 amino acid truncation at or near the N-terminus of the wild-type NiV-G protein (SEQ ID NO:600, SEQ ID NO:618, or SEQ ID NO:628), such as set forth in SEQ ID NO:606 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:606, or such as set forth in SEQ ID NO:634 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:634.

In some embodiments, the mutant NiV-G protein has a 33 amino acid truncation at or near the N-terminus of the wild-type NiV-G protein (SEQ ID NO:600, SEQ ID NO:618, or SEQ ID NO:628) or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:612, or such as set forth in SEQ ID NO:635 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:635.

In some embodiments, the mutant NiV-G protein has a 34 amino acid truncation at or near the N-terminus of the wild-type NiV-G protein (SEQ ID NO:600, SEQ ID NO:618, or SEQ ID NO:628), such as set forth in SEQ ID NO:612 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:612, or such as set forth in SEQ ID NO:635 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:635.

In a preferred embodiment, the NiV-G protein has a 34 amino acid truncation at or near the N-terminus of the wild-type NiV-G protein (SEQ ID NO: 600, SEQ ID NO: 618, or SEQ ID NO: 628) and one or more amino acid substitutions corresponding to amino acid substitutions selected from E501A, W504A, Q530A, and E533A with reference to the numbering set forth in SEQ ID NO: 618.

In some embodiments, the mutant NiV-G protein lacks the N-terminal cytoplasmic domain of the wild-type NiV-G protein (SEQ ID NO:600, SEQ ID NO:618, or SEQ ID NO:628), such as set forth in SEQ ID NO:622 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:622.

In some embodiments, the mutant G protein is a mutant HeV-G protein that has the sequence set forth in SEQ ID NO:609 or 636, or is a functional variant or biologically active portion thereof that has an amino acid sequence having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least or about 96%, at least at or about 97%, at least at or about 98%, or at least at or about 99% sequence identity to SEQ ID NO:609 or 636.

In some embodiments, the G protein is a mutant HeV-G protein that is a biologically active portion of a wild-type HeV-G. In some embodiments, the biologically active portion is an N-terminally truncated fragment. In some embodiments, the mutant HeV-G protein is truncated and lacks up to 5 contiguous amino acid residues at or near the N-terminus of the wild-type HeV-G protein (SEQ ID NO:609 or 636), up to 6 contiguous amino acid residues at or near the N-terminus of the wild-type HeV-G protein (SEQ ID NO:609 or 636), up to 7 contiguous amino acid residues at or near the N-terminus of the wild-type HeV-G protein (SEQ ID NO:609 or 636), up to 8 contiguous amino acid residues at or near the N-terminus of the wild-type HeV-G protein (SEQ ID NO:609 or 636), up to 9 contiguous amino acid residues at or near the N-terminus of the wild-type HeV-G protein (SEQ ID NO:609 or 636), up to 10 contiguous amino acid residues at or near the N-terminus of the wild-type HeV-G protein (SEQ ID NO:609 or 636), up to 11 contiguous amino acid residues at or near the N-terminus of the wild-type HeV-G protein (SEQ ID NO:609 or 636), up to 12 contiguous amino acid residues at or near the N-terminus of the wild-type HeV-G protein (SEQ ID NO:609 or 636), up to 13 contiguous amino acid residues at or near the N-terminus of the wild-type HeV-G protein (SEQ ID NO:609 or 636), up to 14 contiguous amino acid residues at or near the N-terminus of the wild-type HeV-G protein (SEQ ID NO:609 or 636), up to 15 contiguous amino acid residues at or near the N-terminus of the wild-type HeV-G protein (SEQ ID NO:609 or 636), up to 16 contiguous amino acid residues at or near the N-terminus of the wild-type HeV-G protein (SEQ ID NO:609 or 636), up to 17 contiguous amino acid residues at or near the N-terminus of the wild-type HeV-G protein (SEQ ID NO:609 or 636), up to 18 contiguous amino acid residues at or near the N-terminus of the wild-type HeV-G protein (SEQ ID NO:609 or 636), up to 19 contiguous amino acid residues at or near the N-terminus of the wild-type HeV-G protein (SEQ ID NO:609 or 636), up to 20 contiguous amino acid residues at or near the N-terminus of the wild-type HeV-G protein (SEQ ID NO:609 or 636), up to 21 contiguous amino acid residues at or near the N-terminus of the wild-type HeV-G protein (SEQ ID NO:609 or 636), up to 22 contiguous amino acid residues at or near the N-terminus of the wild-type HeV-G protein (SEQ ID NO:609 or 636), up to 23 contiguous amino acid residues at or near the N-terminus of the wild-type HeV-G protein (SEQ ID NO:609 or 636), up to 24 contiguous amino acid residues at or near the N-terminus of the wild-type HeV-G protein (SEQ ID NO:609 or 636), up to 25 contiguous amino acid residues at or near the N-terminus of the wild-type HeV-G protein (SEQ ID NO:609 or 636), up to 26 contiguous amino acid residues at or near the N-terminus of the wild-type HeV-G protein (SEQ ID NO:609 or 636), up to 27 contiguous amino acid residues at or near the N-terminus of the wild-type HeV-G protein (SEQ ID NO:609 or 636), up to 28 contiguous amino acid residues at or near the N-terminus of the wild-type HeV-G protein (SEQ ID NO:609 or 636), up to 29 contiguous amino acid residues at or near the N-terminus of the wild-type HeV-G protein (SEQ ID NO:609 or 636), up to 30 contiguous amino acid residues at or near the N-terminus of the wild-type HeV-G protein (SEQ ID NO:609 or 636), up to 31 contiguous amino acid residues at or near the N-terminus of the wild-type HeV-G protein (SEQ ID NO:609 or 636), up to 32 contiguous amino acid residues at or near the N-terminus of the wild-type HeV-G protein (SEQ ID NO:609 or 636), up to 33 contiguous amino acid residues at or near the N-terminus of the wild-type HeV-G protein (SEQ ID NO:609 or 636), up to 34 contiguous amino acid residues at or near the N-terminus of the wild-type HeV-G protein (SEQ ID NO:609 or 636), up to 35 contiguous amino acid residues at or near the N-terminus of the wild-type HeV-G protein (SEQ ID NO:609 or 636), up to 36 contiguous amino acid residues at or near the N-terminus of the wild-type HeV-G protein (SEQ ID NO:609 or 636), up to 37 contiguous amino acid residues at or near the N-terminus of the wild-type HeV-G protein (SEQ ID NO:609 or 636), up to 38 contiguous amino acid residues at or near the N-terminus of the wild-type HeV-G protein (SEQ ID NO:609 or 636), up to 39 contiguous amino acid residues at or near the N-terminus of the wild-type HeV-G protein (SEQ ID NO:609 or 636), up to 40 contiguous amino acid residues at or near the N-terminus of the wild-type HeV-G protein (SEQ ID NO:609 or 636), up to 41 contiguous amino acid residues at or near the N-terminus of the wild-type HeV-G protein (SEQ ID NO:609 or 636), up to 42 contiguous amino acid residues at or near the N-terminus of the wild-type HeV-G protein (SEQ ID NO:609 or 636), up to 43 contiguous amino acid residues at or near the N-terminus of the wild-type HeV-G protein (SEQ ID NO:609 or 636), up to 44 contiguous amino acid residues at or near the N-terminus of the wild-type HeV-G protein (SEQ ID NO:609 or 636), or up to 45 contiguous amino acid residues at or near the N-terminus of the wild-type HeV-G protein (SEQ ID NO:609 or 636).

In some embodiments, the HeV-G protein is a biologically active portion that does not contain a cytoplasmic domain. In some embodiments, the mutant HeV-G protein lacks the N-terminal cytoplasmic domain of the wild-type HeV-G protein (SEQ ID NO:609 or 636), such as set forth in SEQ ID NO:623 or a functional variant thereof having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:623.

In some embodiments, the G protein or the functionally active variant or biologically active portion thereof binds to Ephrin B2 or Ephrin B3. In some aspects, the G protein has the sequence of amino acids set forth in any one of SEQ ID NO:600, SEQ ID NO:609, SEQ ID NO:618, SEQ ID NO:619, SEQ ID NO:628, SEQ ID NO:620, or SEQ ID NO:621, or is a functionally active variant thereof or a biologically active portion thereof that is able to bind to Ephrin B2 or Ephrin B3. In some embodiments, the functionally active variant or biologically active portion has an amino acid sequence having at least at or about 80%, at least at or about 85%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, and retains binding to Ephrhin B2 or B3.

Reference to retaining binding to Ephrin B2 or B3 includes binding that is at least or at least about 5% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 10% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 15% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 20% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 25% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion, 30% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 35% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 40% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 45% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 50% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 55% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 60% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 65% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, 70% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, such as at least or at least about 75% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, such as at least or at least about 80% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, such as at least or at least about 85% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, such as at least or at least about 90% of the level or degree of binding of the corresponding wild-type G protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof, or such as at least or at least about 95% of the level or degree of binding of the corresponding wild-type protein, such as set forth in SEQ ID NO:600, SEQ ID NO:609, SEQ ID NO:618, SEQ ID NO:619, SEQ ID NO:628, SEQ ID NO:620, or SEQ ID NO:621, or a functionally active variant or biologically active portion thereof. In some embodiments, the G protein is NiV-G or a functionally active variant or biologically active portion thereof and binds to Ephrin B2 or Ephrin B3.

In some aspects, the NiV-G has the sequence of amino acids set forth in SEQ ID NO:600, SEQ ID NO:618, or SEQ ID NO:628, or is a functionally active variant thereof or a biologically active portion thereof that is able to bind to Ephrin B2 or Ephrin B3. In some embodiments, the functionally active variant or biologically active portion has an amino acid sequence having at least at or about 80%, at least at or about 85%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:600, SEQ ID NO:618, or SEQ ID NO:628 and retains binding to Eprhin B2 or B3. Exemplary biologically active portions include N-terminally truncated variants lacking all or a portion of the cytoplasmic domain, e.g. 1 or more, such as 1 to 49 contiguous N-terminal amino acid residues, e.g. set forth in any one of SEQ ID NOS: 601-606, 622, and 629-634.

Reference to retaining binding to Ephrin B2 or B3 includes binding that is at least or at least about 5% of the level or degree of binding of the corresponding wild-type NiV-G, such as set forth in SEQ ID NO:600, SEQ ID NO:618, or SEQ ID NO:628, 10% of the level or degree of binding of the corresponding wild-type NiV-G, such as set forth in SEQ ID NO:600, SEQ ID NO:618, or SEQ ID NO:628, 15% of the level or degree of binding of the corresponding wild-type NiV-G, such as set forth in SEQ ID NO:600, SEQ ID NO:618, or SEQ ID NO:628, 20% of the level or degree of binding of the corresponding wild-type NiV-G, such as set forth in SEQ ID NO:600, SEQ ID NO:618, or SEQ ID NO:6284, 25% of the level or degree of binding of the corresponding wild-type NiV-G, such as set forth in SEQ ID NO:600, SEQ ID NO:618, or SEQ ID NO:628, 30% of the level or degree of binding of the corresponding wild-type NiV-G, such as set forth in S SEQ ID NO:600, SEQ ID NO:618, or SEQ ID NO:628, 35% of the level or degree of binding of the corresponding wild-type NiV-G, such as set forth in SEQ ID NO:600, SEQ ID NO:618, or SEQ ID NO:628, 40% of the level or degree of binding of the corresponding wild-type NiV-G, such as set forth in SEQ ID NO:600, SEQ ID NO:618, or SEQ ID NO:628, 45% of the level or degree of binding of the corresponding wild-type NiV-G, such as set forth in SEQ ID NO:600, SEQ ID NO:618, or SEQ ID NO:628, 50% of the level or degree of binding of the corresponding wild-type NiV-G, such as set forth in SEQ ID NO:600, SEQ ID NO:618, or SEQ ID NO:628, 55% of the level or degree of binding of the corresponding wild-type NiV-G, such as set forth in SEQ ID NO:600, SEQ ID NO:618, or SEQ ID NO:628, 60% of the level or degree of binding of the corresponding wild-type NiV-G, such as set forth in SEQ ID NO:600, SEQ ID NO:618, or SEQ ID NO:628, 65% of the level or degree of binding of the corresponding wild-type NiV-G, such as set forth in SEQ ID NO:600, SEQ ID NO:618, or SEQ ID NO:628, 70% of the level or degree of binding of the corresponding wild-type NiV-G, such as set forth in SEQ ID NO:600, SEQ ID NO:618, or SEQ ID NO:628, such as at least or at least about 75% of the level or degree of binding of the corresponding wild-type NiV-G, such as set forth in SEQ ID NO:600, SEQ ID NO:618, or SEQ ID NO:628, such as at least or at least about 80% of the level or degree of binding of the corresponding wild-type NiV-G, such as set forth in SEQ ID NO:600, SEQ ID NO:618, or SEQ ID NO:628, such as at least or at least about 85% of the level or degree of binding of the corresponding wild-type NiV-G, such as set forth in SEQ ID NO:600, SEQ ID NO:618, or SEQ ID NO:628, such as at least or at least about 90% of the level or degree of binding of the corresponding wild-type NiV-G, such as set forth in SEQ ID NO:600, SEQ ID NO:618, or SEQ ID NO:628, or such as at least or at least about 95% of the level or degree of binding of the corresponding wild-type NiV-G, such as set forth in SEQ ID NO:600, SEQ ID NO:618, or SEQ ID NO:628.

In some embodiments, the G protein is HeV-G or a functionally active variant or biologically active portion thereof and binds to Ephrin B2 or Ephrin B3. In some aspects, the HeV-G has the sequence of amino acids set forth in SEQ ID NO:609 or 636, or is a functionally active variant thereof or a biologically active portion thereof that is able to bind to Ephrin B2 or Ephrin B3. In some embodiments, the functionally active variant or biologically active portion has an amino acid sequence having at least at or about 80%, at least at or about 85%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:609 or 636 and retains binding to Eprhin B2 or B3. Exemplary biologically active portions include N-terminally truncated variants lacking all or a portion of the cytoplasmic domain, e.g. 1 or more, such as 1 to 49 contiguous N-terminal amino acid residues, e.g. set forth in any one of SEQ ID NO:623.

Reference to retaining binding to Ephrin B2 or B3 includes binding that is at least or at least about 5% of the level or degree of binding of the corresponding wild-type HeV-G, such as set forth in SEQ ID NO:609 or 636, 10% of the level or degree of binding of the corresponding wild-type HeV-G, such as set forth in SEQ ID NO:609 or 636, 15% of the level or degree of binding of the corresponding wild-type HeV-G, such as set forth in SEQ ID NO:609 or 636, 20% of the level or degree of binding of the corresponding wild-type HeV-G, such as set forth in SEQ ID NO:609 or 636, 25% of the level or degree of binding of the corresponding wild-type HeV-G, such as set forth in SEQ ID NO:609 or 636, 30% of the level or degree of binding of the corresponding wild-type HeV-G, such as set forth in SEQ ID NO:609 or 636, 35% of the level or degree of binding of the corresponding wild-type HeV-G, such as set forth in SEQ ID NO:609 or 636, 40% of the level or degree of binding of the corresponding wild-type HeV-G, such as set forth in SEQ ID NO:609 or 636, 45% of the level or degree of binding of the corresponding wild-type HeV-G, such as set forth in SEQ ID NO:609 or 636, 50% of the level or degree of binding of the corresponding wild-type HeV-G, such as set forth in SEQ ID NO:609 or 636, 55% of the level or degree of binding of the corresponding wild-type HeV-G, such as set forth in SEQ ID NO:609 or 636, 60% of the level or degree of binding of the corresponding wild-type HeV-G, such as set forth in SEQ ID NO:609 or 636, 65% of the level or degree of binding of the corresponding wild-type HeV-G, such as set forth in SEQ ID NO:609 or 636, 70% of the level or degree of binding of the corresponding wild-type HeV-G, such as set forth in SEQ ID NO:609 or 636, such as at least or at least about 75% of the level or degree of binding of the corresponding wild-type HeV-G, such as set forth in SEQ ID NO:609 or 636, such as at least or at least about 80% of the level or degree of binding of the corresponding wild-type NIV-G, such as set forth in SEQ ID NO:609 or 636, such as at least or at least about 85% of the level or degree of binding of the corresponding wild-type HeV-G, such as set forth in SEQ ID NO:609 or 636, such as at least or at least about 90% of the level or degree of binding of the corresponding wild-type HeV-G, such as set forth in SEQ ID NO:609 or 636, or such as at least or at least about 95% of the level or degree of binding of the corresponding wild-type HeV-G, such as set forth in SEQ ID NO:609 or 636.

In some embodiments, the G protein or the biologically thereof is a mutant G protein that exhibits reduced binding for the native binding partner of a wild-type G protein. In some embodiments, the mutant G protein or the biologically active portion thereof is a mutant of wild-type Niv-G and exhibits reduced binding to one or both of the native binding partners Ephrin B2 or Ephrin B3. In some embodiments, the mutant G-protein or the biologically active portion, such as a mutant NiV-G protein, exhibits reduced binding to the native binding partner. In some embodiments, the reduced binding to Ephrin B2 or Ephrin B3 is reduced by greater than at or about 5%, at or about 10%, at or about 15%, at or about 20%, at or about 25%, at or about 30%, at or about 40%, or or about 50%, at or about 60%, at or about 70%, at or about 80%, at or about 90%, or at or about 100%.

In some embodiments, the mutations described herein can improve transduction efficiency. In some embodiments, the mutations described herein allow for specific targeting of other desired cell types that are not Ephrin B2 or Ephrin B3. In some embodiments, the mutations described herein result in at least the partial inability to bind at least one natural receptor, such as to reduce the binding to at least one of Ephrin B2 or Ephrin B3. In some embodiments, the mutations described herein interfere with natural receptor recognition.

In some embodiments, the mutant NiV-G protein or the biologically active portion thereof is truncated and lacks up to 5 contiguous amino acid residues at or near the N-terminus of the wild-type NiV-G protein (SEQ ID NO:618), 6 contiguous amino acid residues at or near the N-terminus of the wild-type NiV-G protein (SEQ ID NO:618), 7 contiguous amino acid residues at or near the N-terminus of the wild-type NiV-G protein (SEQ ID NO:618), 8 contiguous amino acid residues at or near the N-terminus of the wild-type NiV-G protein (SEQ ID NO:618), 9 contiguous amino acid residues at or near the N-terminus of the wild-type NiV-G protein (SEQ ID NO:618), 10 contiguous amino acid residues at or near the N-terminus of the wild-type NiV-G protein (SEQ ID NO:618), 11 contiguous amino acid residues at or near the N-terminus of the wild-type NiV-G protein (SEQ ID NO:618), 12 contiguous amino acid residues at or near the N-terminus of the wild-type NiV-G protein (SEQ ID NO:618), 13 contiguous amino acid residues at or near the N-terminus of the wild-type NiV-G protein (SEQ ID NO:618), 14 contiguous amino acid residues at or near the N-terminus of the wild-type NiV-G protein (SEQ ID NO:618), 15 contiguous amino acid residues at or near the N-terminus of the wild-type NiV-G protein (SEQ ID NO:618), 16 contiguous amino acid residues at or near the N-terminus of the wild-type NiV-G protein (SEQ ID NO:618), 17 contiguous amino acid residues at or near the N-terminus of the wild-type NiV-G protein (SEQ ID NO:618), 18 contiguous amino acid residues at or near the N-terminus of the wild-type NiV-G protein (SEQ ID NO:618), 19 contiguous amino acid residues at or near the N-terminus of the wild-type NiV-G protein (SEQ ID NO:618), 20 contiguous amino acid residues at or near the N-terminus of the wild-type NiV-G protein (SEQ ID NO:618), 21 contiguous amino acid residues at or near the N-terminus of the wild-type NiV-G protein (SEQ ID NO:618), 22 contiguous amino acid residues at or near the N-terminus of the wild-type NiV-G protein (SEQ ID NO:618), 23 contiguous amino acid residues at or near the N-terminus of the wild-type NiV-G protein (SEQ ID NO:618), 24 contiguous amino acid residues at or near the N-terminus of the wild-type NiV-G protein (SEQ ID NO:618), 25 contiguous amino acid residues at or near the N-terminus of the wild-type NiV-G protein (SEQ ID NO:618), 26 contiguous amino acid residues at or near the N-terminus of the wild-type NiV-G protein (SEQ ID NO:618), 27 contiguous amino acid residues at or near the N-terminus of the wild-type NiV-G protein (SEQ ID NO:618), 28 contiguous amino acid residues at or near the N-terminus of the wild-type NiV-G protein (SEQ ID NO:618), 29 contiguous amino acid residues at or near the N-terminus of the wild-type NiV-G protein (SEQ ID NO:618), 30 contiguous amino acid residues at or near the N-terminus of the wild-type NiV-G protein (SEQ ID NO:618), 31 contiguous amino acid residues at or near the N-terminus of the wild-type NiV-G protein (SEQ ID NO:618), 32 contiguous amino acid residues at or near the N-terminus of the wild-type NiV-G protein (SEQ ID NO:618), 33 contiguous amino acid residues at or near the N-terminus of the wild-type NiV-G protein (SEQ ID NO:618), 34 contiguous amino acid residues at or near the N-terminus of the wild-type NiV-G protein (SEQ ID NO:618), 35 contiguous amino acid residues at or near the N-terminus of the wild-type NiV-G protein (SEQ ID NO:618), 36 contiguous amino acid residues at or near the N-terminus of the wild-type NiV-G protein (SEQ ID NO:618), 37 contiguous amino acid residues at or near the N-terminus of the wild-type NiV-G protein (SEQ ID NO:618), 38 contiguous amino acid residues at or near the N-terminus of the wild-type NiV-G protein (SEQ ID NO:618), 39 contiguous amino acid residues at or near the N-terminus of the wild-type NiV-G protein (SEQ ID NO:618), or 40 contiguous amino acid residues at or near the N-terminus of the wild-type NiV-G protein (SEQ ID NO:618).

In some embodiments, the G protein contains one or more amino acid substitutions in a residue that is involved in the interaction with one or both of Ephrin B2 and Ephrin B3. In some embodiments, the amino acid substitutions correspond to mutations E501A, W504A, Q530A, and E533A with reference to numbering set forth in SEQ ID NO:618.

In some embodiments, the G protein is a mutant G protein containing one or more amino acid substitutions selected from the group consisting of E501A, W504A, Q530A, and E533A with reference to numbering set forth in SEQ ID NO:618. In some embodiments, the G protein is a mutant G protein that contains one or more amino acid substitutions selected from the group consisting of E501A, W504A, Q530A, and E533A with reference to SEQ ID NO:618 or a biologically active portion thereof containing an N-terminal truncation. In some embodiments, the G protein is a mutant G protein that contains one or more amino acid substitutions selected from the group consisting of E501A, W504A, Q530A, and E533A in combination with any one of the N-terminal truncations disclosed above with reference to SEQ ID NO:618 or a biologically active portion thereof. In some embodiments, any of the mutant G proteins described above contains one, two, three, or all four amino acid selected from the group consisting of E501A, W504A, Q530A, and E533A with reference to numbering set forth in SEQ ID NO:618, in all pairwise and triple combinations thereof.

In some embodiments, the mutant NiV-G protein has the amino acid sequence set forth in SEQ ID NO: 607 or 635 or an amino acid sequence having at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO: 607 or 635. In particular embodiments, the G protein has the sequence of amino acids set forth in SEQ ID NO: 607 or 635.

In some embodiments, the targeted envelope protein contains a G protein or a functionally active variant or biologically active portion thereof and an sdAb variable domain, in which the targeted envelope protein exhibits increased binding for another molecule that is different from the native binding partner of a wild-type G protein. In some embodiments, the other molecule can be a protein expressed on the surface of desired target cell. In some embodiments, the increased binding to the other molecule is increased by greater than at or about 25%, at or about 30%, at or about 40%, at or about 50%, at or about 60%, at or about 70%, at or about 80%, at or about 90%, or at or about 100%. In particular embodiments, the binding confers re-targeted binding compared to the binding of a wild-type G protein in which a new or different binding activity is conferred.

In some embodiments, the C-terminus of the single domain antibody is attached to the C-terminus of the G protein or biologically active portion thereof. In some embodiments, the N-terminus of the single domain antibody is exposed on the exterior surface of the lipid bilayer. In some embodiments, the N-terminus of the single domain antibody binds to a cell surface molecule of a target cell. In some embodiments, the single domain antibody specifically binds to a cell surface molecule present on a target cell. In some embodiments, the cell surface molecule is a protein, glycan, lipid, or low molecular weight molecule.

In some embodiments, the cell surface molecule of a target cell is an antigen or portion thereof. In some embodiments, the single domain antibody or portion thereof is an antibody having a single monomeric domain antigen binding/recognition domain that is able to bind selectively to a specific antigen. In some embodiments, the single domain antibody binds an antigen present on a target cell.

Exemplary cells include immune effector cells, peripheral blood mononuclear cells (PBMC) such as lymphocytes (T cells, B cells, natural killer cells) and monocytes, granulocytes (neutrophils, basophils, eosinophils), macrophages, dendritic cells, cytotoxic T lymphocytes, polymorphonuclear cells (also known as PMN, PML, or PMNL), stem cells, embryonic stem cells, neural stem cells, mesenchymal stem cells (MSCs), hematopoietic stem cells (HSCs), human myogenic stem cells, muscle-derived stem cells (MuStem), embryonic stem cells (ES or ESCs), limbal epithelial stem cells, cardio-myogenic stem cells, cardiomyocytes, progenitor cells, allogenic cells, resident cardiac cells, induced pluripotent stem cells (iPS), adipose-derived or phenotypic modified stem or progenitor cells, CD133+ cells, aldehyde dehydrogenase-positive cells (ALDH+), umbilical cord blood (UCB) cells, peripheral blood stem cells (PBSCs), neurons, neural progenitor cells, pancreatic beta cells, glial cells, or hepatocytes.

In some embodiments, the target cell is a cell of a target tissue. The target tissue can include liver, lungs, heart, spleen, pancreas, gastrointestinal tract, kidney, testes, ovaries, brain, reproductive organs, central nervous system, peripheral nervous system, skeletal muscle, endothelium, inner ear, or eye.

In some embodiments, the target cell is a muscle cell (e.g., skeletal muscle cell), kidney cell, liver cell (e.g. hepatocyte), or a cardiac cell (e.g. cardiomyocyte). In some embodiments, the target cell is a cardiac cell, e.g., a cardiomyocyte (e.g., a quiescent cardiomyocyte), a hepatoblast (e.g., a bile duct hepatoblast), an epithelial cell, a T cell (e.g. a naive T cell), a macrophage (e.g., a tumor infiltrating macrophage), or a fibroblast (e.g., a cardiac fibroblast).

In some embodiments, the target cell is a tumor-infiltrating lymphocyte, a T cell, a neoplastic or tumor cell, a virus-infected cell, a stem cell, a central nervous system (CNS) cell, a hematopoeietic stem cell (HSC), a liver cell or a fully differentiated cell. In some embodiments, the target cell is a CD3+ T cell, a CD4+ T cell, a CD8+ T cell, a hepatocyte, a haematepoietic stem cell, a CD34+ haematepoietic stem cell, a CD105+ haematopoietic stem cell, a CD117+ haematopoietic stem cell, a CD105+ endothelial cell, a B cell, a CD20+ B cell, a CD19+ B cell, a cancer cell, a CD133+ cancer cell, an EpCAM+ cancer cell, a CD19+ cancer cell, a Her2/Neu+ cancer cell, a GluA2+ neuron, a GluA4+ neuron, a NKG2D+ natural killer cell, a SLC1A3+ astrocyte, a SLC7A10+ adipocyte, or a CD30+ lung epithelial cell.

In some embodiments, the target cell is an antigen presenting cell, an MHC class II+ cell, a professional antigen presenting cell, an atypical antigen presenting cell, a macrophage, a dendritic cell, a myeloid dendritic cell, a plasmacyteoid dendritic cell, a CD11c+ cell, a CD11b+ cell, a splenocyte, a B cell, a hepatocyte, a endothelial cell, or a non-cancerous cell. In some embodiments, the cell surface molecule is any one of CD8.

In some embodiments, the G protein or functionally active variant or biologically active portion thereof is linked directly to the sdAb variable domain (e.g., a VHH) or scFv. In some embodiments, the targeted envelope protein is a fusion protein that has the following structure: (N'-single domain antibody-C')—(C'-G protein-N'). In some embodiments, the targeted envelope protein is a fusion protein that has the following structure: (N'-scFv-C')—(C'-G protein-N').

In some embodiments, the G protein or functionally active variant or biologically active portion thereof is linked indirectly via a linker to the sdAb variable domain or scFv. In some embodiments, the linker is a peptide linker. In some embodiments, the linker is a chemical linker.

In some embodiments, the linker is a peptide linker and the targeted envelope protein is a fusion protein containing the G protein or functionally active variant or biologically active portion thereof linked via a peptide linker to the sdAb variable domain or svFv. In some embodiments, the targeted envelope protein is a fusion protein that has the following structure: (N'-single domain antibody-C')-Linker-(C'-G protein-N'). In some embodiments, the targeted envelope protein is a fusion protein that has the following structure: (N'-scFv-C')-Linker-(C'-G protein-N'). In some embodiments, the peptide linker is up to 65 amino acids in length. In some embodiments, the peptide linker comprises from or from about 2 to 65 amino acids, 2 to 60 amino acids, 2 to 56 amino acids, 2 to 52 amino acids, 2 to 48 amino acids, 2 to 44 amino acids, 2 to 40 amino acids, 2 to 36 amino acids, 2 to 32 amino acids, 2 to 28 amino acids, 2 to 24 amino acids, 2 to 20 amino acids, 2 to 18 amino acids, 2 to 14 amino acids, 2 to 12 amino acids, 2 to 10 amino acids, 2 to 8 amino acids, 2 to 6 amino acids, 6 to 65 amino acids, 6 to 60 amino acids, 6 to 56 amino acids, 6 to 52 amino acids, 6 to 48 amino acids, 6 to 44 amino acids, 6 to 40 amino acids, 6 to 36 amino acids, 6 to 32 amino acids, 6 to 28 amino acids, 6 to 24 amino acids, 6 to 20 amino acids, 6 to 18 amino acids, 6 to 14 amino acids, 6 to 12 amino acids, 6 to 10 amino acids, 6 to 8 amino acids, 8 to 65 amino acids, 8 to 60 amino acids, 8 to 56 amino acids, 8 to 52 amino acids, 8 to 48 amino acids, 8 to 44 amino acids, 8 to 40 amino acids, 8 to 36 amino acids, 8 to 32 amino acids, 8 to 28 amino acids, 8 to 24 amino acids, 8 to 20 amino acids, 8 to 18 amino acids, 8 to 14 amino acids, 8 to 12 amino acids, 8 to 10 amino acids, 10 to 65 amino acids, 10 to 60 amino acids, 10 to 56 amino acids, 10 to 52 amino acids, 10 to 48 amino acids, 10 to 44 amino acids, 10 to 40 amino acids, 10 to 36 amino acids, 10 to 32 amino acids, 10 to 28 amino acids, 10 to 24 amino acids, 10 to 20 amino acids, 10 to 18 amino acids, 10 to 14 amino acids, 10 to 12 amino acids, 12 to 65 amino acids, 12 to 60 amino acids, 12 to 56 amino acids, 12 to 52 amino acids, 12 to 48 amino acids, 12 to 44 amino acids, 12 to 40 amino acids, 12 to 36 amino acids, 12 to 32 amino acids, 12 to 28 amino acids, 12 to 24 amino acids, 12 to 20 amino acids, 12 to 18 amino acids, 12 to 14 amino acids, 14 to 65 amino acids, 14 to 60 amino acids, 14 to 56 amino acids, 14 to 52 amino acids, 14 to 48 amino acids, 14 to 44 amino acids, 14 to 40 amino acids, 14 to 36 amino acids, 14 to 32 amino acids, 14 to 28 amino acids, 14 to 24 amino acids, 14 to 20 amino acids, 14 to 18 amino acids, 14 to 65 amino acids, 18 to 60 amino acids, 18 to 56 amino acids, 18 to 52 amino acids, 18 to 48 amino acids, 18 to 44 amino acids, 18 to 40 amino acids, 18 to 36 amino acids, 18 to 32 amino acids, 18 to 28 amino acids, 18 to 24 amino acids, 18 to 20 amino acids, 20 to 65 amino acids, 20 to 60 amino acids, 20 to 56 amino acids, 20 to 52 amino acids, 20 to 48 amino acids, 20 to 44 amino acids, 20 to 40 amino acids, 20 to 36 amino acids, 20 to 32 amino acids, 20 to 28 amino acids, 20 to 26 amino acids, 20 to 24 amino acids, 24 to 65 amino acids, 24 to 60 amino acids, 24 to 56 amino acids, 24 to 52 amino acids, 24 to 48 amino acids, 24 to 44 amino acids, 24 to 40 amino acids, 24 to 36 amino acids, 24 to 32 amino acids, 24 to 30 amino acids, 24 to 28 amino acids, 28 to 65 amino acids, 28 to 60 amino acids, 28 to 56 amino acids, 28 to 52 amino acids, 28 to 48 amino acids, 28 to 44 amino acids, 28 to 40 amino acids, 28 to 36 amino acids, 28 to 34 amino acids, 28 to 32 amino acids, 32 to 65 amino acids, 32 to 60 amino acids, 32 to 56 amino acids, 32 to 52 amino acids, 32 to 48 amino acids, 32 to 44 amino acids, 32 to 40 amino acids, 32 to 38 amino acids, 32 to 36 amino acids, 36 to 65 amino acids, 36 to 60 amino acids, 36 to 56 amino acids, 36 to 52 amino acids, 36 to 48 amino acids, 36 to 44 amino acids, 36 to 40 amino acids, 40 to 65 amino acids, 40 to 60 amino acids, 40 to 56 amino acids, 40 to 52 amino acids, 40 to 48 amino acids, 40 to 44 amino acids, 44 to 65 amino acids, 44 to 60 amino acids, 44 to 56 amino acids, 44 to 52 amino acids, 44 to 48 amino acids, 48 to 65 amino acids, 48 to 60 amino acids, 48 to 56 amino acids, 48 to 52 amino acids, 50 to 65 amino acids, 50 to 60 amino acids, 50 to 56 amino acids, 50 to 52 amino acids, 54 to 65 amino acids, 54 to 60 amino acids, 54 to 56 amino acids, 58 to 65 amino acids, 58 to 60 amino acids, or 60 to 65 amino acids. In some embodiments, the peptide linker is a polypeptide that is 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, or 65 amino acids in length.

In particular embodiments, the linker is a flexible peptide linker. In some such embodiments, the linker is 1-20 amino acids, such as 1-20 amino acids predominantly composed of glycine. In some embodiments, the linker is 1-20 amino acids, such as 1-20 amino acids predominantly composed of glycine and serine. In some embodiments, the linker is a flexible peptide linker containing amino acids Glycine and Serine, referred to as GS-linkers. In some embodiments, the peptide linker includes the sequences GS, GGS, GGGGS (SEQ ID NO:627), GGGGGS (SEQ ID NO:625) or combinations thereof. In some embodiments, the polypeptide linker has the sequence (GGS)n, wherein n is 1 to 10. In some embodiments, the polypeptide linker has the sequence (GGGGS)n, (SEQ ID NO:626) wherein n is 1 to 10. In some embodiments, the polypeptide linker has the sequence (GGGGGS)n (SEQ ID NO:27), wherein n is 1 to 6.

Also provided herein are polynucleotides comprising a nucleic acid sequence encoding a targeted envelope protein. In some embodiments, the polynucleotides comprise a nucleic acid sequence encoding a G protein or biologically active portion thereof. In some embodiments, the polynucleotides further comprise a nucleic acid sequence encoding a single domain antibody (sdAb) variable domain or scFv or biologically active portion thereof. The polynucleotides may include a sequence of nucleotides encoding any of the targeted envelope proteins described above. The polynucleotide can be a synthetic nucleic acid. Also provided are expression vectors containing any of the provided polynucleotides.

In some of any embodiments, expression of natural or synthetic nucleic acids is typically achieved by operably linking a nucleic acid encoding the gene of interest to a promoter and incorporating the construct into an expression vector. In some embodiments, vectors can be suitable for replication and integration in eukaryotes. In some embodiments, cloning vectors contain transcription and translation terminators, initiation sequences, and promoters useful for expression of the desired nucleic acid sequence. In some of any embodiments, a plasmid comprises a promoter suitable for expression in a cell.

In some embodiments, the polynucleotides contain at least one promoter that is operatively linked to control expression of the targeted envelope protein containing the G protein and the single domain antibody (sdAb) variable domain or scFv. For expression of the targeted envelope protein, at least one module in each promoter functions to position the start site for RNA synthesis. The best-known example of this is the TATA box, but in some promoters lacking a TATA box, such as the promoter for the mammalian terminal deoxynucleotidyl transferase gene and the promoter for the SV40 genes, a discrete element overlying the start site itself helps to fix the place of initiation.

In some embodiments, additional promoter elements, e.g., enhancers, regulate the frequency of transcriptional initiation. In some embodiments, additional promoter elements are located in the region 30-110 bp upstream of the start site, although a number of promoters have been shown to contain functional elements downstream of the start site as well. In some embodiments, spacing between promoter elements frequently is flexible, so that promoter function is preserved when elements are inverted or moved relative to one another. In some embodiments, such as with the thymidine kinase (tk) promoter, the spacing between promoter elements can be increased to 50 bp apart before activity begins to decline. In some embodiments, depending on the promoter, individual elements can function either cooperatively or independently to activate transcription.

A promoter may be one naturally associated with a gene or polynucleotide sequence, as may be obtained by isolating the 5' non-coding sequences located upstream of the coding segment and/or exon. Such a promoter can be referred to as "endogenous." Similarly, an enhancer may be one naturally associated with a polynucleotide sequence, located either downstream or upstream of that sequence. Alternatively, certain advantages will be gained by positioning the coding polynucleotide segment under the control of a recombinant or heterologous promoter, which refers to a promoter that is not normally associated with a polynucleotide sequence in its natural environment. A recombinant or heterologous enhancer refers also to an enhancer not normally associated with a polynucleotide sequence in its natural environment. Such promoters or enhancers may include promoters or enhancers of other genes, and promoters or enhancers isolated from any other prokaryotic, viral, or eukaryotic cell, and promoters or enhancers not "naturally occurring," i.e., containing different elements of different transcriptional regulatory regions, and/or mutations that alter expression. In addition to producing nucleic acid sequences of promoters and enhancers synthetically, sequences may be produced using recombinant cloning and/or nucleic acid amplification technology, including PCR, in connection with the compositions disclosed herein.

In some embodiments, a suitable promoter is the immediate early cytomegalovirus (CMV) promoter sequence. In some embodiments, the promoter sequence is a strong constitutive promoter sequence capable of driving high levels of expression of any polynucleotide sequence operatively linked thereto. In some embodiments, a suitable promoter is Elongation Growth Factor-Ia (EF-I a). In some embodiments, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter.

In some embodiments, the promoter is an inducible promoter. In some embodiments, the inducible promoter provides a molecular switch capable of turning on expression of the polynucleotide sequence to which it is operatively linked when such expression is desired, or turning off the expression when expression is not desired. In some embodiments, inducible promoters comprise a metallothionine promoter, a glucocorticoid promoter, a progesterone promoter, and a tetracycline promoter.

In some embodiments, exogenously controlled inducible promoters can be used to regulate expression of the G protein and single domain antibody (sdAb) variable domain or scFv. For example, radiation-inducible promoters, heat-inducible promoters, and/or drug-inducible promoters can be used to selectively drive transgene expression in, for example, targeted regions. In such embodiments, the location, duration, and level of transgene expression can be regulated by the administration of the exogenous source of induction.

In some embodiments, expression of the targeted envelope protein containing a G protein and single domain antibody (sdAb) variable domain or scFv is regulated using a drug-inducible promoter. For example, in some cases, the promoter, enhancer, or transactivator comprises a Lac operator sequence, a tetracycline operator sequence, a galactose operator sequence, a doxycycline operator sequence, a rapamycin operator sequence, a tamoxifen operator sequence, or a hormone-responsive operator sequence, or an analog thereof. In some instances, the inducible promoter comprises a tetracycline response element (TRE). In some embodiments, the inducible promoter comprises an estrogen response element (ERE), which can activate gene expression in the presence of tamoxifen. In some instances, a drug-inducible element, such as a TRE, can be combined with a selected promoter to enhance transcription in the presence of drug, such as doxycycline. In some embodiments, the drug-inducible promoter is a small molecule-inducible promoter.

Any of the provided polynucleotides can be modified to remove CpG motifs and/or to optimize codons for translation in a particular species, such as human, canine, feline, equine, ovine, bovine, etc. species. In some embodiments, the polynucleotides are optimized for human codon usage (i.e., human codon-optimized). In some embodiments, the polynucleotides are modified to remove CpG motifs. In other embodiments, the provided polynucleotides are modified to remove CpG motifs and are codon-optimized, such as human codon-optimized. Methods of codon optimization and CpG motif detection and modification are well-known. Typically, polynucleotide optimization enhances transgene expression, increases transgene stability and preserves the amino acid sequence of the encoded polypeptide.

In order to assess the expression of the targeted envelope protein, the expression vector to be introduced into a cell can also contain either a selectable marker gene or a reporter gene or both to facilitate identification and selection of expressing particles, e.g. viral particles. In other embodiments, the selectable marker may be carried on a separate piece of DNA and used in a co-transfection procedure. Both selectable markers and reporter genes may be flanked with appropriate regulatory sequences to enable expression in the host cells. Useful selectable markers are known in the art and include, for example, antibiotic-resistance genes, such as neo and the like.

Reporter genes are used for identifying potentially transfected cells and for evaluating the functionality of regulatory sequences. Reporter genes that encode for easily assayable proteins are well known in the art. In general, a reporter gene is a gene that is not present in or expressed by the recipient organism or tissue and that encodes a protein whose expression is manifested by some easily detectable property, e.g., enzymatic activity. Expression of the reporter gene is assayed at a suitable time after the DNA has been introduced into the recipient cells.

Suitable reporter genes may include genes encoding luciferase, beta-galactosidase, chloramphenicol acetyl transferase, secreted alkaline phosphatase, or the green fluorescent protein gene (see, e.g., Ui-Tei et al., 2000, FEBS Lett. 479:79-82). Suitable expression systems are well known and may be prepared using well known techniques or obtained commercially. Internal deletion constructs may be generated using unique internal restriction sites or by partial digestion of non-unique restriction sites. Constructs may then be transfected into cells that display high levels of the desired polynucleotide and/or polypeptide expression. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Lipid Particles Targeting CD8

Also provided herein are targeted lipid particles (e.g. targeting CD8), such as targeted viral vectors, that comprise a henipavirus F protein molecule or biologically active portion thereof, and a fusion protein comprising (i) a henipavirus envelope attachment glycoprotein G (G protein) or a biologically active portion thereof, and (ii) a single domain antibody (sdAb) variable domain or scFv, wherein the single domain antibody variable domain or scFv is attached to the C-terminus of the G protein or the biologically active portion, wherein each is exposed on the outer surface of the targeted viral vector. In particular embodiments, the provided targeted lipid particles exhibit fusogenic activity, which is mediated by the targeted envelope protein that facilitates binding to a target cell and contains the G protein or biologically active portion thereof, and the F protein or biologically active portion thereof that is involved in facilitating the merger or fusion of the two lumens of the lipid particle and the target cell membranes. Table 7 provides non-limiting examples of G and F proteins for use in the targeted lipid particles of the disclosure.

In some embodiments, the targeted lipid particle provided herein (e.g. targeted lentiviral vector) has increased or greater expression of the targeted envelope protein compared to a reference lipid particle (e.g. reference lentiviral vector) that incorporates a similar envelope protein but that is fused to an alternative targeting moiety other than a sdAb variable domain, such as a single chain variable fragment (scFv). In some embodiments, the targeted viral vectors are produced by pseudotyping of viral vectors (e.g lentiviral particles) following co-transfection of the packaging cells with the transfer, envelope, and gag-pol plasmids.

In some embodiments, the expression is increased by at or greater than 5%, 10%, 20%, 30%, 40%, 50%, 60%, 70%, 80%, 90%, 100%, 125%, 150%, 200%, 300%, 400%, 500% or more, compared to a reference lipid particle (e.g. reference lentiviral vector), e.g. a reference lipid particle containing a similar envelope protein but that is fused to an scFv. In some examples, the expression is increased by at or greater than 1.5-fold, 2-fold, 3-fold, 4-fold, 5-fold, 6-fold, 7-fold, 8-fold, 9-fold, 10-fold, 15-fold, 20-fold, 30-fold or more, compared to a reference lipid particle (e.g. reference lentiviral vector), e.g. a reference lipid particle containing a similar envelope protein but that is fused to an scFv. In some embodiments, expression can be assayed in vitro using flow cytometry, e.g. FACs. In some embodiments, expression can be depicted as the number or density of targeted envelope protein on the surface of a targeted viral vector (e.g. targeted lentiviral vector). In some embodiments, expression can be depicted as the mean fluorescent intensity (MFI) of surface expression of the targeted envelope protein on the surface of a targeted viral vector (e.g. targeted lentiviral vector). In some embodiments, expression can be depicted as the percent of lipid particle (e.g. lentiviral vectors) in a population that are surface positive for the targeted envelope protein.

In some embodiments, in a population of targeted lipid particles (e.g. targeted lentiviral vectors) greater than at or about 50% of the lipid particles are surface positive for the targeted envelope protein. For example, in a population of provided targeted viral vectors (e.g. targeted lentiviral vectors) greater than at or about 55%, greater than at or about 60%, greater than at or about 65%, greater than at or about 70%, or greater than at or about 75% of the viral vectors in the population are surface positive for the targeted envelope protein.

In some embodiments, titer of the targeted lipid particles following introduction into target cells, such as by transduction (e.g. transduced cells), is increased compared to titer into the same target cells of reference lipid particles (e.g. reference lentiviral vector) that incorporate a similar envelope protein but fused to an alternative targeting moiety other than a sdAb variable domain, such as a single chain variable fragment (scFv). Typically, the alternative targeting moiety recognizes or binds the same target molecule as the sdAb variable domain of the targeted envelope protein of the targeted lipid particles. In some embodiments, the titer is increased by at or greater than 5%, 10%, 20%, 30%, 40%, 50%, 60%, 70%, 80%, 90%, 100%, 125%, 150%, 200%, 300%, 400%, 500% or more, compared to titer of a reference lipid particle (e.g. reference lentiviral vector), e.g. a reference lipid particle containing a similar envelope protein but that is fused to an scFv. In some examples, the titer is increased by at or greater than 1.5-fold, 2-fold, 3-fold, 4-fold, 5-fold, 6-fold, 7-fold, 8-fold, 9-fold, 10-fold, 15-fold, 20-fold, 30-fold or more, compared to the titer of a reference lipid particle (e.g. reference lentiviral vector), e.g. a reference viral vector containing a similar envelope protein but that is fused to an scFv. In some embodiments, the titer of the targeted viral vectors in target cells (e.g. transduced cells) is greater than at or about $1\times10^6$ transduction units (TU)/mL. For example, the titer of the targeted viral vectors in target cells (e.g. transduced cells) is greater than at or about $2\times10^6$ TU/mL, greater than at or about $3\times10^6$ TU/mL, greater than at or about $4\times10^6$ TU/mL, greater than at or about 5×10⁶ TU/mL, greater than at or about 6×10⁶ TU/mL, greater than at or about 7×10⁶ TU/mL, greater than at or about 8×10⁶ TU/mL, greater than at or about 9×10⁶ TU/mL, or greater than at or about 1×10⁷ TU/mL.

A. F Proteins

In some embodiments, the targeted lipid particle comprises one or more fusogens, e.g. henipavirus F proteins. In some embodiments, the targeted lipid particle contains an exogenous or overexpressed fusogen. In some embodiments, the fusogen is disposed in the lipid bilayer. In some embodiments, the fusogen facilitates the fusion of the targeted particle's lipid bilayer to a membrane. In some embodiments, the membrane is a plasma cell membrane.

In some embodiments, fusogens comprise protein based, lipid based, and chemical based fusogens. In some embodiments, the targeted lipid particle comprises a first fusogen comprising a protein fusogen and a second fusogen comprising a lipid fusogen or chemical fusogen. In some embodiments, the fusogen binds a fusogen binding partner on a target cell surface.

In some embodiments, the fusogen comprises a protein with a hydrophobic fusion peptide domain. In some embodiments, the fusogen comprises a henipavirus F protein molecule or biologically active portion thereof. In some embodiments, the Henipavirus F protein is a Hendra (Hey) virus F protein, a Nipah (NiV) virus F-protein, a Cedar (CedPV) virus F protein, a Mojiang virus F protein, a bat Paramyxovirus F protein, or a biologically active portion thereof.

In some embodiments, the N-terminal hydrophobic fusion peptide domain of the F protein molecule or biologically active portion thereof is exposed on the outside of a lipid bilayer.

F proteins of henipaviruses are encoded as $F_0$ precursors containing a signal peptide (e.g. corresponding to amino acid residues 1-26 of SEQ ID NO: 592). Following cleavage of the signal peptide, the mature $F_0$ (e.g. SEQ ID NO: 593) is transported to the cell surface, then endocytosed and cleaved by cathepsin L (e.g. between amino acids 109-110 of SEQ ID NO: 592) into the mature fusogenic subunits F1 (e.g. corresponding to amino acids 110-546 of SEQ ID NO:592; set forth in SEQ ID NO:595) and F2 (e.g. corresponding to amino acid residues 27-109 of SEQ ID NO:1; set forth in SEQ ID NO:594). The F1 and F2 subunits are associated by a disulfide bond and recycled back to the cell surface. The F1 subunit contains the fusion peptide domain located at the N terminus of the F1 subunit (e.g., corresponding to amino acids 110-129 of SEQ ID NO:592) where it is able to insert into a cell membrane to drive fusion. In some cases, fusion activity is blocked by association of the F protein with G protein, until G engages with a target molecule resulting in its disassociation from F and exposure of the fusion peptide to mediate membrane fusion.

Among different henipavirus species, the sequence and activity of the F protein is highly conserved. For examples, the F protein of NiV and HeV viruses share 89% amino acid sequence identity. Further, in some cases, the henipavirus F proteins exhibit compatibility with G proteins from other species to trigger fusion (Brandel-Tretheway et al. Journal of Virology. 2019. 93(13):e00577-19). In some aspects of the provided targeted lipid particle, the F protein is heterologous to the G protein, i.e., the F and G protein or biologically active portions thereof are from different henipavirus species. For example, the F protein is from Hendra virus and the G protein is from Nipah virus. In other aspects, the F protein can be a chimeric F protein containing regions of F proteins from different species of Henipavirus. In some embodiments, switching a region of amino acid residues of the F protein from one species of Henipavirus to another can result in fusion to the G protein of the species comprising the amino acid insertion. (Brandel-Tretheway et al. 2019). In some cases, the chimeric F protein contains an extracellular domain from one henipavirus species and a transmembrane and/or cytoplasmic domain from a different henipavirus species. For example, the F protein may contain an extracellular domain of Hendra virus and a transmembrane/cytoplasmic domain of Nipah virus. F protein sequences disclosed herein are predominantly disclosed as expressed sequences including an N-terminal signal sequence. Such N-terminal signal sequences are commonly cleaved co- or post-translationally, thus the mature protein sequences for all F protein sequences disclosed herein are also contemplated as lacking the N-terminal signal sequence.

In some embodiments, the F protein is encoded by a nucleotide sequence that encodes the sequence set forth by any one of SEQ ID NOs: 592, 593, 608, 614-616, or 641-644, or is a functionally active variant or a biologically active portion thereof that has a sequence that is at least at or about 80%, at least at or about 85%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% identical to any one of SEQ ID NOS: 592, 593, 608, 614-616, or 641-644. In particular embodiments, the F protein or the functionally active variant or biologically active portion thereof retains fusogenic activity in conjunction with a Henipavirus G protein, such as a G protein set forth herein. Fusogenic activity includes the activity of the F protein in conjunction with a Henipavirus G protein to promote or facilitate fusion of two membrane lumens, such as the lumen of the targeted lipid particle having embedded in its lipid bilayer a henipavirus F and G protein, and a cytoplasm of a target cell, e.g., a cell that contains a surface receptor or molecule that is recognized or bound by the targeted envelope protein. In some embodiments, the F protein and G protein are from the same Henipavirus species (e.g. NiV-G and NiV-F). In some embodiments, the F protein and G protein are from different Henipavirus species (e.g., NiV-G and HeV-F). In particular embodiments, the F protein of the functionally active variant or biologically active portion retains the cleavage site cleaved by cathepsin L (e.g., corresponding to the cleavage site between amino acids 109-110 of SEQ ID NO:592).

In particular embodiments, the F protein has the sequence of amino acids set forth in SEQ ID NO:592, SEQ ID NO:593, SEQ ID NO:608, SEQ ID NO:614, SEQ ID NO:615, SEQ ID NO:616, SEQ ID NO:641, SEQ ID NO:642, SEQ ID NO:643, or SEQ ID NO:644 or is a functionally active variant thereof or a biologically active portion thereof that retains fusogenic activity. In some embodiments, the functionally active variant comprises an amino acid sequence having at least at or about 80%, at least at or about 85%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:592, SEQ ID NO:593, SEQ ID NO:608, SEQ ID NO:614, SEQ ID NO:615, SEQ ID NO:616, SEQ ID NO:641, SEQ ID NO:642, SEQ ID NO:643, or SEQ ID NO:644 and retains fusogenic activity in conjunction with a Henipavirus G protein (e.g., NiV-G or HeV-G). In some embodiments, the biologically active portion has an amino acid sequence having at least at or about 80%, at least at or about 85%, at least at or about 90%, at least at or about 91%, at least at or about 92%, at least at or about 93%, at least at or about 94%, at least at or about 95%, at or about 96%, at least at or about 97%, at least at or about 98%, or at least at or about 99% sequence identity to SEQ ID NO:592, SEQ ID NO:593, SEQ ID NO:608, SEQ ID NO:614, SEQ ID NO:615, SEQ ID NO:616, SEQ ID NO:641, SEQ ID NO:642, SEQ ID NO:643, or SEQ ID NO:644 and retains fusogenic activity in conjunction with a Henipavirus G protein (e.g., NiV-G or HeV-G).

Reference to retaining fusogenic activity includes activity (in conjunction with a Henipavirus G protein) that is at or about 10% to at or about 150% or more of the level or degree of binding of the corresponding wild-type F protein, such as set forth in SEQ ID NO:592, SEQ ID NO:593, SEQ ID NO:608, SEQ ID NO:614, SEQ ID NO:615, SEQ ID NO:616, SEQ ID NO:641, SEQ ID NO:642, SEQ ID NO:643, or SEQ ID NO:644, such as at least or at least about 10% of the level or degree of fusogenic activity of the corresponding wild-type F protein, such as at least or at least about 15% of the level or degree of fusogenic activity of the corresponding wild-type F protein, such as at least or at least about 20% of the level or degree of fusogenic activity of the corresponding wild-type F protein, such as at least or at least about 25% of the level or degree of fusogenic activity of the corresponding wild-type F protein, such as at least or at least about 30% of the level or degree of fusogenic activity of the corresponding wild-type F protein, such as at least or at least about 35% of the level or degree of fusogenic activity of the corresponding wild-type F protein, such as at least or at least about 40% of the level or degree of fusogenic activity of the corresponding wild-type F protein, such as at least or at least about 45% of the level or degree of fusogenic activity of the corresponding wild-type F protein, such as at least or at least about 50% of the level or degree of fusogenic activity of the corresponding wild-type F protein, such as at least or at least about 55% of the level or degree of fusogenic activity of the corresponding wild-type f protein, such as at least or at least about 60% of the level or degree of fusogenic activity of the corresponding wild-type F protein, such as at least or at least about 65% of the level or degree of fusogenic activity of the corresponding wild-type F protein, such as at least or at least about 70% of the level or degree of fusogenic activity of the corresponding wild-type F protein, such as at least or at least about 75% of the level or degree of fusogenic activity of the corresponding wild-type F protein, such as at least or at least about 80% of the level or degree of fusogenic activity of the corresponding wild-type F protein, such as at least or at least about 85% of the level or degree of fusogenic activity of the corresponding wild-type F protein, such as at least or at least about 90% of the level or degree of fusogenic activity of the corresponding wild-type F protein, such as at least or at least about 95% of the level or degree of fusogenic activity of the corresponding wild-type F protein, such as at least or at least about 100% of the level or degree of fusogenic activity of the corresponding wild-type F protein, or such as at least or at least about 120% of the level or degree of fusogenic activity of the corresponding wild-type F protein.

In some embodiments, the F protein is a mutant F protein that is a functionally active fragment or a biologically active portion containing one or more amino acid mutations, such as one or more amino acid insertions, deletions, substitutions, or truncations. In some embodiments, the mutations described herein relate to amino acid insertions, deletions, substitutions, or truncations of amino acids compared to a reference F protein sequence. In some embodiments, the reference F protein sequence is the wild-type sequence of an F protein or a biologically active portion thereof. In some embodiments, the mutant F protein or the biologically active portion thereof is a mutant of a wild-type Hendra (Hey) virus F protein, a Nipah (NiV) virus F-protein, a Cedar (CedPV) virus F protein, a Mojiang virus F protein, or a bat Paramyxovirus F protein. In some embodiments, the wild-type F protein is encoded by a sequence of nucleotides that encodes any one of SEQ ID NO: 592, 593, 608, 614-616, or 641-644.

In some embodiments, the mutant F protein is a biologically active portion of a wild-type F protein that is an N-terminally and/or C-terminally truncated fragment. In some embodiments, the mutant F protein or the biologically active portion of a wild-type F protein thereof comprises one or more amino acid substitutions. In some embodiments, the mutations described herein can improve transduction efficiency. In some embodiments, the mutations described herein can increase fusogenic capacity. Exemplary mutations include any as described, see e.g. Khetawat and Broder 2010 Virology Journal 7:312; Witting et al. 2013 Gene Therapy 20:997-1005; published international; patent application No. WO/2013/148327.

In some embodiments, the mutant F protein is a biologically active portion that is truncated and lacks up to 20 contiguous amino acid residues at or near the C-terminus of the wild-type F protein, such as a wild-type F protein encoded by a sequence of nucleotides encoding the F protein set forth in any one of SEQ ID NOS: 592, 593, 608, or 614-616. In some embodiments, the mutant F protein is truncated and lacks up to 19 contiguous amino acids, such as up to 18, 17, 16, 15, 14, 13, 12, 11, 10, 9, 8, 7, 6, 5, 4, 3, 2, or 1 contiguous amino acid(s) at the C-terminus of the wild-type F protein.

In some embodiments, the F protein or the functionally active variant or biologically active portion thereof comprises an F1 subunit or a fusogenic portion thereof. In some embodiments, the F1 subunit is a proteolytically cleaved portion of the F0 precursor. In some embodiments, the F0 precursor is inactive. In some embodiments, the cleavage of the F0 precursor forms a disulfide-linked F1+F2 heterodimer. In some embodiments, the cleavage exposes the fusion peptide and produces a mature F protein. In some embodiments, the cleavage occurs at or around a single basic residue. In some embodiments, the cleavage occurs at Arginine 109 of NiV-F protein. In some embodiments, cleavage occurs at Lysine 109 of the Hendra virus F protein.

In some embodiments, the F protein is a wild-type Nipah virus F (NiV-F) protein or is a functionally active variant or biologically active protein thereof. In some embodiments, the $F_0$ precursor is encoded by a sequence of nucleotides encoding the sequence set forth in SEQ ID NO:592. The encoding nucleic acid can encode a signal peptide sequence that has the sequence MVVILDKRCY CNLLILILMI SECSVG (SEQ ID NO:624) or another signal peptide sequence. In some embodiments, the F protein has the sequence set forth in SEQ ID NO:593. In some examples, the F protein is cleaved into an F1 subunit comprising the sequence set forth in SEQ ID NO:595 and an F2 subunit comprising the sequence set forth in SEQ ID NO:594.

In some embodiments, the F protein is a NiV-F protein that is encoded by a sequence of nucleotides encoding the sequence set forth in SEQ ID NO:592, or is a functionally active variant or biologically active portion thereof that has an amino acid sequence having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:592. In some embodiments, the NiV-F-protein has the sequence of set forth in SEQ ID NO:593, or is a functionally active variant or a biologically active portion thereof that has an amino acid sequence having at least at or about 80%, at least at or about 81%, at least at or about 82%, at least at or about 83%, at least at or about 84%, at least at or about 85%, at least at or about 86%, at least at or about 87%, at least at or about 88%, at least at or about 89%, at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:593. In particular embodiments, the F protein or the functionally active variant or biologically active portion thereof retains the cleavage site cleaved by cathepsin L (e.g., corresponding to the cleavage site between amino acids 109-110 of SEQ ID NO:592).

In some embodiments, the F protein or the functionally active variant or the biologically active portion thereof includes an F1 subunit that has the sequence set forth in SEQ ID NO:595, or an amino acid sequence having, at least at or about 80%, at least at or about 81%, at least at or about 82%, at least at or about 83%, at least at or about 84%, at least at or about 85%, at least at or about 86%, at least at or about 87%, at least at or about 88%, at least at or about 89% at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:595.

In some embodiments, the F protein or the functionally active variant or biologically active portion thereof includes an F2 subunit that has the sequence set forth in SEQ ID NO:594, or an amino acid sequence having, at least at or about 80%, at least at or about 81%, at least at or about 82%, at least at or about 83%, at least at or about 84%, at least at or about 85%, at least at or about 86%, at least at or about 87%, at least at or about 88%, at least at or about 89% at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:594.

In some embodiments, the F protein is a mutant NiV-F protein that is a biologically active portion thereof that is truncated and lacks up to 20 contiguous amino acid residues at or near the C-terminus of the wild-type NiV-F protein (e.g., set forth SEQ ID NO:593). In some embodiments, the mutant NiV-F protein comprises an amino acid sequence set forth in SEQ ID NO:596. In some embodiments, the mutant NiV-F protein has a sequence that has at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:596. In some embodiments, the mutant F protein contains an F1 protein that has the sequence set forth in SEQ ID NO:597. In some embodiments, the mutant F protein has a sequence that has at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:597.

In some embodiments, the F protein is a mutant NiV-F protein that is a biologically active portion thereof that comprises a 20 amino acid truncation at or near the C-terminus of the wild-type NiV-F protein (SEQ ID NO:593); and a point mutation on an N-linked glycosylation site. In some embodiments, the mutant NiV-F protein comprises an amino acid sequence set forth in SEQ ID NO:598. In some embodiments, the mutant NiV-F protein has a sequence that has at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:598.

In some embodiments, the F protein is a mutant NiV-F protein that is a biologically active portion thereof that comprises a 22 amino acid truncation at or near the C-terminus of the wild-type NiV-F protein (SEQ ID NO:593). In some embodiments, the NiV-F protein comprises an amino acid sequence set forth in SEQ ID NO:599. In some embodiments, the NiV-F protein has a sequence with at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:599. In some embodiments, the NiV-F protein comprises an amino acid sequence set forth in SEQ ID NO:1092. In some embodiments, the NiV-F protein has a sequence with at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:1092. In some embodiments, the NiV-F protein comprises an amino acid sequence set forth in SEQ ID NO:1093. In some embodiments, the NiV-F protein has a sequence with at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:1093. In particular embodiments, the variant F protein is a mutant Niv-F protein that has the sequence of amino acids set forth in SEQ ID NO:613. In some embodiments, the NiV-F protein has a sequence with at least at or about 90%, at least at or about 91%, at least at or about 92%, at least at or about 93%, at least at or about 94%, at least at or about 95%, at least at or about 96%, at least at or about 97%, at least at or about 98%, or at least at or about 99% sequence identity to SEQ ID NO:613.

B. Lipid Bilayer

In some embodiments, the targeted lipid particle includes a naturally derived bilayer of amphipathic lipids that encloses a lumen or cavity. In some embodiments, the targeted lipid particle comprises a lipid bilayer as the outermost surface. In some embodiments, the lipid bilayer encloses a lumen. In some embodiments, the lumen is aqueous. In some embodiments, the lumen is in contact with the hydrophilic head groups on the interior of the lipid bilayer. In some embodiments, the lumen is a cytosol. In some embodiments, the cytosol contains cellular components present in a source cell. In some embodiments, the cytosol does not contain cellular components present in a source cell. In some embodiments, the lumen is a cavity. In some embodiments, the cavity contains an aqueous environment. In some embodiments, the cavity does not contain an aqueous environment.

In some aspects, the lipid bilayer is derived from a source cell during a process to produce a lipid-containing particle. In some embodiments, the lipid bilayer includes membrane components of the cell from which the lipid bilayer is produced, e.g., phospholipids, membrane proteins, etc. In some embodiments, the lipid bilayer includes a cytosol that includes components found in the cell from which the lipid bilayer is produced, e.g., solutes, proteins, nucleic acids, etc., but not all of the components of a cell, e.g., it lacks a nucleus. In some embodiments, the lipid bilayer is considered to be exosome-like. The lipid particle may vary in size, and in some instances have a diameter ranging from 30 and 300 nm, such as from 30 and 150 nm, and including from 40 to 100 nm.

In some embodiments, the lipid bilayer is a viral envelope. In some embodiments, the viral envelope is obtained from a source cell. In some embodiments, the viral envelope is obtained by the viral capsid from the source cell plasma membrane. In some embodiments, the lipid bilayer is obtained from a membrane other than the plasma membrane of a host cell. In some embodiments, the viral envelope lipid bilayer is embedded with viral proteins, including viral glycoproteins.

In other aspects, the lipid bilayer includes synthetic lipid complex. In some embodiments, the synthetic lipid complex is a liposome. In some embodiments, the lipid particle is a vesicular structure characterized by a phospholipid bilayer membrane and an inner aqueous medium. In some embodiments, the lipid bilayer has multiple lipid layers separated by aqueous medium. In some embodiments, the lipid bilayer forms spontaneously when phospholipids are suspended in an excess of aqueous solution. In some examples, the lipid components undergo self-rearrangement before the formation of closed structures and entrap water and dissolved solutes between the lipid bilayers.

In some embodiments, a targeted envelope protein and fusogen, such as any described above including any that are exogenous or overexpressed relative to the source cell, is disposed in the lipid bilayer.

In some embodiments, the targeted lipid particle comprises several different types of lipids. In some embodiments, the lipids are amphipathic lipids. In some embodiments, the amphipathic lipids are phospholipids. In some embodiments, the phospholipids comprise phosphatidylcholine, phosphatidylethanolamine, phosphatidylinositol, and phosphatidylserine. In some embodiments, the lipids comprise phospholipids such as phosphocholines and phosphoinositols. In some embodiments, the lipids comprise DMPC, DOPC, and DSPC.

In some embodiments, the bilayer may be comprised of one or more lipids of the same or different type. In some embodiments, the source cell comprises a cell selected from CHO cells, BHK cells, MDCK cells, C3H 10T1/2 cells, FLY cells, Psi-2 cells, BOSC 23 cells, PA317 cells, WEHI cells, COS cells, BSC 1 cells, BSC 40 cells, BMT 10 cells, VERO cells, W138 cells, MRC5 cells, A549 cells, HT1080 cells, 293 cells, 293T cells, B-50 cells, 3T3 cells, NIH3T3 cells, HepG2 cells, Saos-2 cells, Huh7 cells, HeLa cells, W163 cells, 211 cells, and 211A cells.

C. Exogenous Agent

In some embodiments, the targeted lipid particle further comprises an agent that is exogenous relative to the source cell (also referred to herein as a "cargo" or "payload"). In some embodiments, the exogenous agent is a small molecule, a protein, or a nucleic acid (e.g., a DNA, a chromosome (e.g. a human artificial chromosome), an RNA, e.g., an mRNA or miRNA). In some embodiments, the exogenous agent or cargo encodes a cytosolic protein. In some embodiments the exogenous agent or cargo comprises or encodes a membrane protein. In some embodiments, the exogenous agent or cargo comprises a therapeutic agent. In some embodiments, the therapeutic agent is chosen from one or more of a protein, e.g., an enzyme, a transmembrane protein, a receptor, an antibody; a nucleic acid, e.g., DNA, a chromosome (e.g. a human artificial chromosome), RNA, mRNA, siRNA, miRNA; or a small molecule.

In some embodiments, the exogenous agent is present in at least, or no more than, 10, 20, 50, 100, 200, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies. In some embodiments, the targeted lipid particle has an altered, e.g., increased or decreased level of one or more endogenous molecules, e.g., protein or nucleic acid (e.g., in some embodiments, endogenous relative to the source cell, and in some embodiments, endogenous relative to the target cell), e.g., due to treatment of the source cell, e.g., mammalian source cell with a siRNA or gene editing enzyme. In some embodiments, the endogenous molecule is present in at least, or no more than, 10, 20, 50, 100, 200, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies. In some embodiments, the endogenous molecule (e.g., an RNA or protein) is present at a concentration of at least 1, 2, 3, 4, 5, 10, 20, 50, 100, 500, $10^3$, $5.0 \times 10^3$, $10^4$, $5.0 \times 10^4$, $10^5$, $5.0 \times 10^5$, $10^6$, $5.0 \times 10^6$, $1.0 \times 10^7$, $5.0 \times 10^7$, or $1.0 \times 10^8$, greater than its concentration in the source cell. In some embodiments, the endogenous molecule (e.g., an RNA or protein) is present at a concentration of at least 1, 2, 3, 4, 5, 10, 20, 50, 100, 500, $10^3$, $5.0 \times 10^3$, $10^4$, $5.0 \times 10^4$, $10^5$, $5.0 \times 10^5$, $10^6$, $5.0 \times 10^6$, $1.0 \times 10^7$, $5.0 \times 10^7$, or $1.0 \times 10^8$ less than its concentration in the source cell.

In some embodiments, the targeted lipid particle (e.g., targeted viral vector) delivers to a target cell at least 10%, 20%, 30%, 40%, 50%, 60%, 70%, 80%, 90%, 95%, 96%, 97%, 98%, or 99% of the cargo (e.g., a therapeutic agent, e.g., an exogenous therapeutic agent) comprised by the targeted lipid particle. In some embodiments, the targeted lipid particle that fuses with the target cell(s) delivers to the target cell an average of at least 10%, 20%, 30%, 40%, 50%, 60%, 70%, 80%, 90%, 95%, 96%, 97%, 98%, or 99% of the cargo (e.g., a therapeutic agent, e.g., an exogenous therapeutic agent) comprised by the targeted lipid particle that fuses with the target cell(s). In some embodiments, the targeted lipid particle composition delivers to a target tissue at least 10%, 20%, 30%, 40%, 50%, 60%, 70%, 80%, 90%, 95%, 96%, 97%, 98%, or 99% of the cargo (e.g., a therapeutic agent, e.g., an exogenous therapeutic agent) comprised by the targeted lipid particle composition.

In some embodiments, the exogenous agent or cargo is not expressed naturally in the cell from which the targeted lipid particle is derived. In some embodiments, the exogenous agent or cargo is expressed naturally in the cell from which the viral vector is derived. In some embodiments, the exogenous agent or cargo is loaded into the targeted lipid particle via expression in the cell from which the viral vector is derived (e.g. expression from DNA or mRNA introduced via transfection, transduction, or electroporation). In some embodiments, the exogenous agent or cargo is expressed from DNA integrated into the genome or maintained episosomally. In some embodiments, expression of the exogenous agent or cargo is constitutive. In some embodiments, expression of the exogenous agent or cargo is induced. In some embodiments, expression of the exogenous agent or cargo is induced immediately prior to generating the targeted lipid particle. In some embodiments, expression of the exogenous agent or cargo is induced at the same time as expression of the fusogen.

In some embodiments, the exogenous agent or cargo is loaded into the viral vector via electroporation into the viral vector itself or into the cell from which the viral vector is derived. In some embodiments, the exogenous agent or cargo is loaded into the viral vector via transfection (e.g., of a DNA or mRNA encoding the cargo) into the viral vector itself or into the cell from which the viral vector is derived.

In some embodiments, the exogenous agent or cargo may include one or more nucleic acid sequences, one or more polypeptides, a combination of nucleic acid sequences and/or polypeptides, one or more organelles, and any combination thereof. In some embodiments, the exogenous agent or cargo may include one or more cellular components. In some embodiments, the exogenous agent or cargo includes one or more cytosolic and/or nuclear components.

In some embodiments, the exogenous agent or cargo includes a nucleic acid, e.g., DNA, nDNA (nuclear DNA), mtDNA (mitochondrial DNA), protein coding DNA, gene, operon, chromosome, genome, transposon, retrotransposon, viral genome, intron, exon, modified DNA, mRNA (messenger RNA), tRNA (transfer RNA), modified RNA, microRNA, siRNA (small interfering RNA), tmRNA (transfer messenger RNA), rRNA (ribosomal RNA), mtRNA (mitochondrial RNA), snRNA (small nuclear RNA), small nucleolar RNA (snoRNA), SmY RNA (mRNA trans-splicing RNA), gRNA (guide RNA), TERC (telomerase RNA component), aRNA (antisense RNA), cis-NAT (Cis-natural antisense transcript), CRISPR RNA (crRNA), lncRNA (long noncoding RNA), piRNA (piwi-interacting RNA), shRNA (short hairpin RNA), tasiRNA (trans-acting siRNA), eRNA (enhancer RNA), satellite RNA, pcRNA (protein coding RNA), dsRNA (double stranded RNA), RNAi (interfering RNA), circRNA (circular RNA), reprogramming RNAs, aptamers, and any combination thereof. In some embodiments, the nucleic acid is a wild-type nucleic acid. In some embodiments, the nucleic acid is a mutant nucleic acid. In some embodiments the nucleic acid is a fusion or chimera of multiple nucleic acid sequences.

In some embodiments, the exogenous agent or cargo may include a nucleic acid. For example, the exogenous agent or cargo may comprise RNA to enhance expression of an endogenous protein, or a siRNA or miRNA that inhibits protein expression of an endogenous protein. For example, the endogenous protein may modulate structure or function in the target cells. In some embodiments, the cargo may include a nucleic acid encoding an engineered protein that modulates structure or function in the target cells. In some embodiments, the exogenous agent or cargo is a nucleic acid that targets a transcriptional activator that modulate structure or function in the target cells.

In some embodiments, the exogenous agent or cargo includes a polypeptide, e.g., enzymes, structural polypeptides, signaling polypeptides, regulatory polypeptides, transport polypeptides, sensory polypeptides, motor polypeptides, defense polypeptides, storage polypeptides, transcription factors, antibodies, cytokines, hormones, catabolic polypeptides, anabolic polypeptides, proteolytic polypeptides, metabolic polypeptides, kinases, transferases, hydrolases, lyases, isomer ases, ligases, enzyme modulator polypeptides, protein binding polypeptides, lipid binding polypeptides, membrane fusion polypeptides, cell differentiation polypeptides, epigenetic polypeptides, cell death polypeptides, nuclear transport polypeptides, nucleic acid binding polypeptides, reprogramming polypeptides, DNA editing polypeptides, DNA repair polypeptides, DNA recombination polypeptides, transposase polypeptides, DNA integration polypeptides, targeted endonucleases (e.g. Zinc-finger nucleases, transcription-activator-like nucleases (TALENs), cas9 and homologs thereof), recombinases, and any combination thereof. In some embodiments the protein targets a protein in the cell for degradation. In some embodiments the protein targets a protein in the cell for degradation by localizing the protein to the proteasome. In some embodiments, the protein is a wild-type protein. In some embodiments, the protein is a mutant protein. In some embodiments the protein is a fusion or chimeric protein.

In some embodiments, the exogenous agent or cargo includes a small molecule, e.g., ions (e.g. $Ca^{2+}$, $Cl^-$, $Fe^{2+}$), carbohydrates, lipids, reactive oxygen species, reactive nitrogen species, isoprenoids, signaling molecules, heme, polypeptide cofactors, electron accepting compounds, electron donating compounds, metabolites, ligands, and any combination thereof. In some embodiments the small molecule is a pharmaceutical that interacts with a target in the cell. In some embodiments the small molecule targets a protein in the cell for degradation. In some embodiments the small molecule targets a protein in the cell for degradation by localizing the protein to the proteasome. In some embodiments that small molecule is a proteolysis targeting chimera molecule (PROTAC).

In some embodiments, the exogenous agent or cargo includes a mixture of proteins, nucleic acids, or metabolites, e.g., multiple polypeptides, multiple nucleic acids, multiple small molecules; combinations of nucleic acids, polypeptides, and small molecules; ribonucleoprotein complexes (e.g. Cas9-g RNA complex); multiple transcription factors, multiple epigenetic factors, reprogramming factors (e.g. Oct4, Sox2, cMyc, and Klf4); multiple regulatory RNAs; and any combination thereof.

In some embodiments, the exogenous agent or cargo includes one or more organelles, e.g., chondrisomes, mitochondria, lysosomes, nucleus, cell membrane, cytoplasm, endoplasmic reticulum, ribosomes, vacuoles, endosomes, spliceosomes, polymerases, capsids, acrosome, autophagosome, centriole, glycosome, glyoxysome, hydrogenosome, melanosome, mitosome, myofibril, cnidocyst, peroxisome, proteasome, vesicle, stress granule, networks of organelles, and any combination thereof.

In some embodiments, the exogenous agent encodes a therapeutic agent or a diagnostic agent. In some embodiments, the therapeutic agent is a chimeric antigen receptor (CAR) or T-cell receptor (TCR). In some embodiments, the CAR targets a tumor antigen selected from CD19, CD20, CD22, or BCMA. In another embodiment, the CAR is engineered to comprise an intracellular signaling domain of the T cell antigen receptor complex zeta chain (e.g., CD3 zeta). In a preferred embodiment, the intracellular domain is selected from a CD137 (4-1 BB) signaling domain, a CD28 signaling domain, and a CD3zeta signaling domain.

D. Methods of Generating Targeted Lipid Particles Derived from Virus

Provided herein are targeted lipid particles that are derived from virus, such as viral particles or virus-like particles, including those derived from retroviruses or lentiviruses. In some embodiments, the targeted lipid particle's bilayer of amphipathic lipids is or comprises the viral envelope. In some embodiments, the targeted lipid particle's bilayer of amphipathic lipids is or comprises lipids derived from a producer cell. In some embodiments, the viral envelope may comprise a fusogen, e.g., a fusogen that is endogenous to the virus or a pseudotyped fusogen. In some embodiments, the targeted lipid particles's lumen or cavity comprises a viral nucleic acid, e.g., a retroviral nucleic acid, e.g., a lentiviral nucleic acid. In some embodiments, the viral nucleic acid may be a viral genome. In some embodiments, the targeted lipid particle further comprises one or more viral non-structural proteins, e.g., in its cavity or lumen. In some embodiments, the targeted lipid particles is or comprises a virus-like particle (VLP). In some embodiments, the VLP does not comprise an envelope. In some embodiments, the VLP comprises an envelope.

In some embodiments, the viral particle or virus-like particle, such as a retrovirus or retrovirus-like particle, comprises one or more of a Gag polyprotein, polymerase (e.g., Pol), integrase (IN, e.g., a functional or non-functional variant), protease (PR), Rev, Tat, and a fusogen. In some embodiments, the targeted lipid particle comprises Rev. In some embodiments, the targeted lipid particle comprises Tat. In some embodiments, one or more of the aforesaid proteins are encoded in the retroviral genome, and in some embodiments, one or more of the aforesaid proteins are provided in trans, e.g., by a helper cell, helper virus, or helper plasmid. In some embodiments, the targeted lipid particle nucleic acid (e.g., retroviral nucleic acid) comprises one or more of the following nucleic acid sequences: 5' LTR (e.g., comprising U5 and lacking a functional U3 domain), Psi packaging element (Psi), Central polypurine tract (cPPT) Promoter operatively linked to the payload gene, payload gene (optionally comprising an intron before the open reading frame), Poly A tail sequence, WPRE, and 3' LTR (e.g., comprising U5 and lacking a functional U3). In some embodiments the targeted lipid particle nucleic acid further comprises one or more insulator elements. In some embodiments, the recognition sites are situated between the poly A tail sequence and the WPRE.

In some embodiments, the targeted lipid particle comprises supramolecular complexes formed by viral proteins that self-assemble into capsids. In some embodiments, the targeted lipid particle is a viral particle or virus-like particle derived from viral capsids. In some embodiments, the targeted lipid particle is a viral particle or virus-like particle derived from viral nucleocapsids. In some embodiments, the targeted lipid particle comprises nucleocapsid-derived proteins that retain the property of packaging nucleic acids. In some embodiments, the viral particles or virus-like particles comprises only viral structural glycoproteins. In some embodiments, the targeted lipid particle does not contain a viral genome.

In some embodiments, the targeted lipid particle packages nucleic acids from host cells during the expression process. In some embodiments, the nucleic acids do not encode any genes involved in virus replication. In particular embodiments, the targeted lipid particle is a virus-like particle, e.g. retrovirus-like particle such as a lentivirus-like particle, that is replication defective.

In some cases, the targeted lipid particle is a viral particle that is morphologically indistinguishable from the wild type infectious virus. In some embodiments, the viral particle presents the entire viral proteome as an antigen. In some embodiments, the viral particle presents only a portion of the proteome as an antigen.

In some embodiments, the viral particle or virus-like particle is produced utilizing proteins (e.g., envelope proteins) from a virus within the Paramyxoviridae family. In some embodiments, the Paramyxoviridae family comprises members within the Henipavirus genus. In some embodiments, the Henipavirus is or comprises a Hendra (HeV) or a Nipah (NiV) virus. In particular embodiments, the viral particles or virus-like particles incorporate a targeted envelope protein and fusogen.

In some embodiments, viral particles or virus-like particles may be produced in multiple cell culture systems including bacteria, mammalian cell lines, insect cell lines, yeast, and plant cells.

Suitable cell lines which can be used include, for example, CHO cells, BHK cells, MDCK cells, C3H 10T1/2 cells, FLY cells, Psi-2 cells, BOSC 23 cells, PA317 cells, WEHI cells, COS cells, BSC 1 cells, BSC 40 cells, BMT 10 cells, VERO cells, W138 cells, MRC5 cells, A549 cells, HT1080 cells, 293 cells, 293T cells, B-50 cells, 3T3 cells, NIH3T3 cells, HepG2 cells, Saos-2 cells, Huh7 cells, HeLa cells, W163 cells, 211 cells, 211A cells, and cyno and *Macaca nemestrina* cell lines. In embodiments, the packaging cells are 293 cells, 293T cells, or A549 cells.

In some embodiments, a source cell line includes a cell line which is capable of producing recombinant retroviral particles, comprising a producer cell line and a transfer vector construct comprising a packaging signal. Methods of preparing viral stock solutions are illustrated by, e.g., Y. Soneoka et al. (1995) *Nucl. Acids Res.* 23:628-633, and N. R. Landau et al. (1992) *J. Virol.* 66:5110-5113, which are incorporated herein by reference.

In some embodiments, the assembly of a viral particle or virus-like particle is initiated by binding of the core protein to a unique encapsidation sequence within the viral genome (e.g. UTR with stem-loop structure). In some embodiments, the interaction of the core with the encapsidation sequence facilitates oligomerization.

In some embodiments, the targeted lipid particle is a virus-like particle which comprises a sequence that is devoid of or lacking viral RNA. In some embodiments, such particles may be the result of removing or eliminating the viral RNA from the sequence. In some embodiments, this may be achieved by using an endogenous packaging signal binding site on Gag. In some embodiments, the endogenous packaging signal binding site is on Pol. In some embodiments, the RNA which is to be delivered will contain a cognate packaging signal. In some embodiments, a heterologous binding domain (which is heterologous to Gag) located on the RNA to be delivered, and a cognate binding site located on Gag or Pol, can be used to ensure packaging of the RNA to be delivered. In some embodiments, the heterologous sequence could be non-viral or it could be viral, in which case it may be derived from the same virus or a different virus. In some embodiments, the vector particles could be used to deliver therapeutic RNA, in which case functional integrase and/or reverse transcriptase is not required. In some embodiments, the vector particles could also be used to deliver a therapeutic gene of interest, in which case Pol is typically included. In some embodiments, the retroviral nucleic acid comprises one or more of (e.g., all of): a 5' promoter (e.g., to control expression of the entire packaged RNA), a 5' LTR (e.g., that includes R (polyadenylation tail signal) and/or U5 which includes a primer activation signal), a primer binding site, a Psi packaging signal, a RRE element for nuclear export, a promoter directly upstream of the transgene to control transgene expression, a transgene (or other exogenous agent element), a polypurine tract, and a 3' LTR (e.g., that includes a mutated U3, a R, and U5). In some embodiments, the retroviral nucleic acid further comprises one or more of a cPPT, a WPRE, and/or an insulator element.

A retrovirus typically replicates by reverse transcription of its genomic RNA into a linear double-stranded DNA copy and subsequently covalently integrates its genomic DNA into a host genome. Illustrative retroviruses suitable for use in particular embodiments, include, but are not limited to: Moloney murine leukemia virus (M-MuLV), Moloney murine sarcoma virus (MoMSV), Harvey murine sarcoma virus (HaMuSV), murine mammary tumor virus (MuMTV), gibbon ape leukemia virus (GaLV), feline leukemia virus (FLV), spumavirus, Friend murine leukemia virus, Murine Stem Cell Virus (MSCV), Rous Sarcoma Virus (RSV), and other lentiviruses.

In some embodiments the retrovirus is a Gammaretrovirus. In some embodiments the retrovirus is an Epsilonretrovirus. In some embodiments the retrovirus is an Alpharetrovirus. In some embodiments the retrovirus is a Betaretrovirus. In some embodiments the retrovirus is a Deltaretrovirus. In some embodiments the retrovirus is a Lentivirus. In some embodiments the retrovirus is a Spumaretrovirus. In some embodiments the retrovirus is an endogenous retrovirus.

Illustrative lentiviruses include, but are not limited to: HIV (human immunodeficiency virus; including HIV type 1, and HIV type 2); visna-maedi virus (VMV) virus; the caprine arthritis-encephalitis virus (CAEV); equine infectious anemia virus (EIAV); feline immunodeficiency virus (FIV); bovine immune deficiency virus (BIV); and simian immunodeficiency virus (SIV). In some embodiments, HIV based vector backbones (i.e., HIV cis-acting sequence elements) are used.

In some embodiments, a vector herein is a nucleic acid molecule capable transferring or transporting another nucleic acid molecule. The transferred nucleic acid is generally linked to, e.g., inserted into, the vector nucleic acid molecule. A vector may include sequences that direct autonomous replication in a cell, or may include sequences sufficient to allow integration into host cell DNA. Useful vectors include, for example, plasmids (e.g., DNA plasmids or RNA plasmids), transposons, cosmids, bacterial artificial chromosomes, and viral vectors. Useful viral vectors include, e.g., replication defective retroviruses and lentiviruses.

In some embodiments, a viral vector comprises a nucleic acid molecule (e.g., a transfer plasmid) that includes virus-derived nucleic acid elements that typically facilitate transfer of the nucleic acid molecule or integration into the genome of a cell or to a viral particle that mediates nucleic acid transfer. Viral particles will typically include various viral components and sometimes also host cell components in addition to nucleic acid(s). In some embodiments, a viral vector comprises e.g., a virus or viral particle capable of transferring a nucleic acid into a cell, or the transferred nucleic acid (e.g., as naked DNA). In some embodiments, a viral vectors and transfer plasmids comprise structural and/ or functional genetic elements that are primarily derived from a virus. A retroviral vector can comprise a viral vector or plasmid containing structural and functional genetic elements, or portions thereof, that are primarily derived from a retrovirus. A lentiviral vector can comprise a viral vector or plasmid containing structural and functional genetic elements, or portions thereof, including LTRs that are primarily derived from a lentivirus.

In embodiments, a lentiviral vector (e.g., lentiviral expression vector) may comprise a lentiviral transfer plasmid (e.g., as naked DNA) or an infectious lentiviral particle. With respect to elements such as cloning sites, promoters, regulatory elements, heterologous nucleic acids, etc., it is to be understood that the sequences of these elements can be present in RNA form in lentiviral particles and can be present in DNA form in DNA plasmids.

In some embodiments, in the vectors described herein at least part of one or more protein coding regions that contribute to or are essential for replication may be absent compared to the corresponding wild-type virus. In some embodiments, the viral vector is replication-defective. In some embodiments, the vector is capable of transducing a target non-dividing host cell and/or integrating its genome into a host genome.

In some embodiments, different cells differ in their usage of particular codons. In some embodiments, this codon bias corresponds to a bias in the relative abundance of particular tRNAs in the cell type. In some embodiments, by altering the codons in the sequence so that they are tailored to match with the relative abundance of corresponding tRNAs, it is possible to increase expression. In some embodiments, it is possible to decrease expression by deliberately choosing codons for which the corresponding tRNAs are known to be rare in the particular cell type. In some embodiments, an additional degree of translational control is available. An additional description of codon optimization is found, e.g., in WO 99/41397, which is herein incorporated by reference in its entirety.

Conventional techniques for generating retrovirus vectors (and, in particular, lentivirus vectors) with or without the use of packaging/helper vectors are known to those skilled in the art and may be used to generate targeted lipid particles according to the present disclosure. (See, e.g., Derse and Newbold 1993 Virology 194:530-6; Maury et al. 1994 Virology 200:632-42; Wanisch et al. 2009. Mol Ther. 1798: 1316-1332; Martarano et al. 1994 J. Virol. 68:3102-11; Naldini et al., (1996a, 1996b, and 1998); Zufferey et al., 1999, J. Virol., 73:2886; Huang et al., Mol. Cell. Biol., 5:3864; Liu et al., 1995, Genes Dev., 9:1766; Cullen et al., 1991. J. Virol. 65: 1053; and Cullen et al., 1991. Cell 58: 423; Dull et al., 1998, U.S. Pat. Nos. 6,013,516; and 5,994,136; PCT patent applications WO 99/15683, WO 98/17815, WO 99/32646, and WO 01/79518). Conventional techniques relating to packaging vectors and producer cells known in the art may also be used according to the present disclosure. (See, e.g., Yao et al, 1998; Jones et al, 2005.)

Provided herein are targeted lipid particles that comprise a naturally derived membrane. In some embodiments, the naturally derived membrane comprises membrane vesicles prepared from cells or tissues. In some embodiments, the targeted lipid particle comprises a vesicle that is obtainable from a cell. In some embodiments, the targeted lipid particle comprises a microvesicle, an exosome, a membrane enclosed body, an apoptotic body (from apoptotic cells), a particle (which may be derived from e.g. platelets), an ectosome (derivable from, e.g., neutrophiles and monocytes in serum), a prostatosome (obtainable from prostate cancer cells), or a cardiosome (derivable from cardiac cells).

In some embodiments, the source cell is an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell), a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial gial cell, a bone marrow stromal cell, a pancreatic progenitor cell, an endothelial progenitor cell, a blast cell), or an immortalized cell (e.g., HeEa, HEK293, HFF-I, MRC-5, WI-38, IMR 90, IMR 91, PER.C6, HT-1080, or BJ cell). In some embodiments, the source cell is other than a 293 cell, HEK cell, human endothelial cell, or a human epithelial cell, monocyte, macrophage, dendritic cell, or stem cell.

In some embodiments, the targeted lipid particle has a density of <1, 1-1.1, 1.05-1.15, 1.1-1.2, 1.15-1.25, 1.2-1.3, 1.25-1.35, or >1.35 g/ml. In some embodiments, the targeted lipid particle composition comprises less than 0.01%, 0.05%, 0.1%, 0.5%, 1%, 1.5%, 2%, 2.5%, 3%, 4%, 5%, or 10% source cells by protein mass, or less than 0.01%, 0.05%, 0.1%, 0.5%, 1%, 1.5%, 2%, 2.5%, 3%, 4%, 5%, or 10% of cells having a functional nucleus.

In embodiments, the targeted lipid particle has a size, or the population of targeted lipid particles have an average size, that is less than about 0.01%, 0.05%, 0.1%, 0.5%, 1%, 2%, 3%, 4%, 5%, 10%, 20%, 30%, 40%, 50%, 60%, 70%, 80%, 90%, of that of the source cell.

In some embodiments the targeted lipid particle comprises an extracellular vesicle, e.g., a cell-derived vesicle comprising a membrane that encloses an internal space and has a smaller diameter than the cell from which it is derived. In embodiments the extracellular vesicle has a diameter from 20 nm to 1000 nm. In embodiments the targeted lipid particle comprises an apoptotic body, a fragment of a cell, a vesicle derived from a cell by direct or indirect manipulation, a vesiculated organelle, and a vesicle produced by a living cell (e.g., by direct plasma membrane budding or fusion of the late endosome with the plasma membrane). In embodiments the extracellular vesicle is derived from a living or dead organism, explanted tissues or organs, or cultured cells.

In embodiments, the targeted lipid particle comprises a nanovesicle, e.g., a cell-derived small (e.g., between 20-250 nm in diameter, or 30-150 nm in diameter) vesicle comprising a membrane that encloses an internal space, and which is generated from said cell by direct or indirect manipulation. The production of nanovesicles can, in some instances, result in the destruction of the source cell. The nanovesicle may comprise a lipid or fatty acid and polypeptide.

In embodiments, the targeted lipid particle comprises an exosome. In embodiments, the exosome is a cell-derived small (e.g., between 20-300 nm in diameter, or 40-200 nm in diameter) vesicle comprising a membrane that encloses an internal space, and which is generated from said cell by direct plasma membrane budding or by fusion of the late endosome with the plasma membrane. In embodiments, production of exosomes does not result in the destruction of the source cell. In embodiments, the exosome comprises lipid or fatty acid and polypeptide.

In some embodiments, the targeted lipid particle is derived from a source cell with a genetic modification which results in increased expression of an immunomodulatory agent. In some embodiments, the immunosuppressive agent is on an exterior surface of the cell. In some embodiments, the immunosuppressive agent is incorporated into the exterior surface of the targeted lipid particle. In some embodiments, the targeted lipid particle comprises an immunomodulatory agent attached to the surface of the solid particle by a covalent or non-covalent bond.

a. Generation of Cell-Derived Particles

In some embodiments, targeted lipid particles are generated by inducing budding of an exosome, microvesicle, membrane vesicle, extracellular membrane vesicle, plasma membrane vesicle, giant plasma membrane vesicle, apoptotic body, mitoparticle, pyrenocyte, lysosome, or other membrane enclosed vesicle.

In some embodiments, targeted lipid particles are generated by inducing cell enucleation. Enucleation may be performed using assays such as genetic, chemical (e.g., using Actinomycin D, see Bayona-Bafaluyet al., "A chemical enucleation method for the transfer of mitochondrial DNA to ρ° cells" Nucleic Acids Res. 2003 Aug. 15; 31(16): e98), or mechanical methods (e.g., squeezing or aspiration, see Lee et al., "A comparative study on the efficiency of two enucleation methods in pig somatic cell nuclear transfer: effects of the squeezing and the aspiration methods." Anim Biotechnol. 2008; 19(2):71-9), or combinations thereof.

In some embodiments, the targeted lipid particles are generated by inducing cell fragmentation. In some embodiments, cell fragmentation can be performed using the following methods, including, but not limited to: chemical methods, mechanical methods (e.g., centrifugation (e.g., ultracentrifugation, or density centrifugation), freeze-thaw, or sonication), or combinations thereof.

In some embodiments, the targeted lipid particle is a microvesicle. In some embodiments the microvesicle has a diameter of about 100 nm to about 2000 nm. In some embodiments, a targeted lipid particle comprises a cell ghost. In some embodiments, a vesicle is a plasma membrane vesicle, e.g., a giant plasma membrane vesicle.

In some embodiments, a characteristic of a targeted lipid particle is described by comparison to a reference cell. In embodiments, the reference cell is the source cell. In embodiments, the reference cell is a HeLa, HEK293, HFF-1, MRC-5, WI-38, IMR 90, IMR 91, PER.C6, HT-1080, or BJ cell. In some embodiments, for example when the source cell used to make the targeted lipid particle is not available for testing after the targeted lipid particle is made, a characteristic of a population of targeted lipid particle is described by comparison to a population of reference cells, e.g., a population of source cells, or a population of HeLa, HEK293, HFF-1, MRC-5, WI-38, IMR 90, IMR 91, PER.C6, HT-1080, or BJ cells.

Pharmaceutical Compositions

The present disclosure also provides, in some aspects, a pharmaceutical composition comprising the targeted lipid particle (e.g., targeted viral vectors) composition described herein and a pharmaceutically acceptable carrier. The pharmaceutical compositions can include any of the described targeted viral vectors.

In some embodiments, the targeted viral vector meets a pharmaceutical or good manufacturing practices (GMP) standard. In some embodiments, the targeted viral vector is made according to good manufacturing practices (GMP). In some embodiments, the targeted viral vector has a pathogen level below a predetermined reference value, e.g., is substantially free of pathogens. In some embodiments, the targeted viral vector has a contaminant level below a predetermined reference value, e.g., is substantially free of contaminants. In some embodiments, the targeted viral vector has low immunogenicity.

In some embodiments, provided herein are the use of pharmaceutical compositions to practice the methods of the disclosure. Such a pharmaceutical composition may consist of at least one targeted lipid particle of the disclosure in a form suitable for administration to a subject, or the pharmaceutical composition may comprise at least one targeted lipid particle of the disclosure and one or more pharmaceutically acceptable carriers, one or more additional ingredients, or some combination of these.

In some embodiments, the relative amounts of the targeted lipid particle, the pharmaceutically acceptable carrier, and any additional ingredients in a pharmaceutical composition of the disclosure will vary, depending upon the identity, size, and condition of the subject treated and further depending upon the route by which the composition is to be administered. In some embodiments, the composition may comprise between 0.1% and 100% (w/w) of the targeted lipid particles of the disclosure.

In some embodiments, pharmaceutical compositions that are useful in the methods of the disclosure may be suitably developed for intravenous, intratumoral, oral, rectal, vaginal, parenteral, topical, pulmonary, intranasal, buccal, ophthalmic, or another route of administration. In some embodiments, a composition useful within the methods of the disclosure may be directly administered to the skin, vagina or any other tissue of a mammal. In some embodiments, formulations include liposomal preparations, resealed erythrocytes containing the targeted lipid particles of the disclosure, and immunologically based formulations. In some embodiments, the route(s) of administration will be readily apparent to the skilled artisan and will depend upon any number of factors including the type and severity of the disease being treated, the type and age of the veterinary or human subject being treated, and the like.

In some embodiments, formulations of the pharmaceutical compositions described herein may be prepared by any method known or hereafter developed in the art of pharmacology. In some embodiments, preparatory methods include the step of bringing the targeted lipid particles of the disclosure into association with a carrier or one or more other accessory ingredients, and then, if necessary or desirable, shaping or packaging the product into a desired single- or multi-dose unit.

In some embodiments, a "unit dose" is a discrete amount of the pharmaceutical composition comprising a predetermined amount of the targeted lipid particles of the disclosure. In some embodiments, the amount is generally equal to the dosage that would be administered to a subject or a convenient fraction of such a dosage such as, for example, one-half or one-third of such a dosage. In some embodiments, the unit dosage form may be for a single daily dose or one of multiple daily doses (e.g., about 1 to 4 or more times per day). In some embodiments, when multiple daily doses are used, the unit dosage form may be the same or different for each dose.

In some embodiments, although the descriptions of pharmaceutical compositions provided herein are principally directed to pharmaceutical compositions that are suitable for ethical administration to humans, it will be understood by the skilled artisan that such compositions are generally suitable for administration to animals of all sorts. In some embodiments, modification of pharmaceutical compositions suitable for administration to humans in order to render the compositions suitable for administration to various animals is well understood, and the ordinarily skilled veterinary pharmacologist may design and perform such modification with merely ordinary, if any, experimentation. In some embodiments, subjects to which administration of the pharmaceutical compositions of the disclosure is contemplated include humans and other primates, mammals including commercially relevant mammals such as cattle, pigs, horses, sheep, cats, and dogs.

In some of any embodiments, the compositions of the disclosure are formulated using one or more pharmaceutically acceptable excipients or carriers. In one embodiment, the pharmaceutical compositions of the disclosure comprise a therapeutically effective amount of a targeted lipid particle of the disclosure and a pharmaceutically acceptable carrier. In some embodiments, pharmaceutically acceptable carriers that are useful, include, but are not limited to, glycerol, water, saline, ethanol, and other pharmaceutically acceptable salt solutions such as phosphates and salts of organic acids. Examples of these and other pharmaceutically acceptable carriers are described in Remington's Pharmaceutical Sciences (1991, Mack Publication Co., New Jersey).

In some embodiments, the carrier may be a solvent or dispersion medium containing, for example, water, ethanol, polyol (for example, glycerol, propylene glycol, and liquid polyethylene glycol, and the like), suitable mixtures thereof, and vegetable oils. In some embodiments, the proper fluidity may be maintained, for example, by the use of a coating such as lecithin, by the maintenance of the required particle size in the case of dispersion and by the use of surfactants. In some embodiments, prevention of the action of microorganisms may be achieved by various antibacterial and antifungal agents, for example, parabens, chlorobutanol, phenol, ascorbic acid, thimerosal, and the like. In some embodiments, it is preferable to include isotonic agents, for example, sugars, sodium chloride, or polyalcohols such as mannitol and sorbitol, in the composition. In some embodiments, prolonged absorption of the injectable compositions may be brought about by including in the composition an agent that delays absorption, for example, aluminum monostearate or gelatin. In one embodiment, the pharmaceutically acceptable carrier is not DMSO alone.

In some embodiments, formulations may be employed in admixtures with conventional excipients, i.e., pharmaceutically acceptable organic or inorganic carrier substances suitable for oral, vaginal, parenteral, nasal, intravenous, subcutaneous, enteral, or any other suitable mode of administration, known to the art. In some embodiments, the pharmaceutical preparations may be sterilized and, if desired, mixed with auxiliary agents, e.g., lubricants, preservatives, stabilizers, wetting agents, emulsifiers, salts for influencing osmotic pressure buffers, coloring, flavoring, and/or aromatic substances and the like. In some embodiments, pharmaceutical preparations may also be combined with other active agents, e.g., other analgesic agents.

In some embodiments, "additional ingredients" include, but are not limited to, one or more of the following: excipients; surface active agents; dispersing agents; inert diluents; granulating and disintegrating agents; binding agents; lubricating agents; sweetening agents; flavoring agents; coloring agents; preservatives; physiologically degradable compositions such as gelatin; aqueous vehicles and solvents; oily vehicles and solvents; suspending agents; dispersing or wetting agents; emulsifying agents, demulcents; buffers; salts; thickening agents; fillers; emulsifying agents; antioxidants; antibiotics; antifungal agents; stabilizing agents; and pharmaceutically acceptable polymeric or hydrophobic materials. In some embodiments, "additional ingredients" that may be included in the pharmaceutical compositions of the disclosure are known in the art and described, for example in Genaro, ed. (1985, Remington's Pharmaceutical Sciences, Mack Publishing Co., Easton, Pa.), which is incorporated herein by reference.

In some embodiments, the composition of the disclosure may comprise a preservative from about 0.005% to 2.0% by total weight of the composition. In some embodiments, the preservative is used to prevent spoilage in the case of exposure to contaminants in the environment. In some embodiments, examples of preservatives useful in accordance with the disclosure included but are not limited to those selected from the group consisting of benzyl alcohol, sorbic acid, parabens, imidurea and combinations thereof. In some embodiments, a particularly preferred preservative is a combination of about 0.5% to 2.0% benzyl alcohol and 0.05% to 0.5% sorbic acid.

In some embodiments, liquid suspensions may be prepared using conventional methods to achieve suspension of the targeted lipid particles of the disclosure in an aqueous or oily vehicle. In some embodiments, aqueous vehicles include, for example, water, and isotonic saline. In some embodiments, oily vehicles include, for example, almond oil, oily esters, ethyl alcohol, vegetable oils such as arachis, olive, sesame, or coconut oil, fractionated vegetable oils, and mineral oils such as liquid paraffin. In some embodiments, liquid suspensions may further comprise one or more additional ingredients including, but not limited to, suspending agents, dispersing or wetting agents, emulsifying agents, demulcents, preservatives, buffers, salts, flavorings, coloring agents, and sweetening agents. In some embodiments, oily suspensions may further comprise a thickening agent. In some embodiments, suspending agents include, but are not limited to, sorbitol syrup, hydrogenated edible fats, sodium alginate, polyvinylpyrrolidone, gum tragacanth, gum acacia, and cellulose derivatives such as sodium carboxymethylcellulose, methylcellulose, hydroxypropylmethylcellulose. In some embodiments, dispersing or wetting agents include, but are not limited to, naturally-occurring phosphatides such as lecithin, condensation products of an alkylene oxide with a fatty acid, with a long chain aliphatic alcohol, with a partial ester derived from a fatty acid and a hexitol, or with a partial ester derived from a fatty acid and a hexitol anhydride (e.g., polyoxyethylene stearate, heptadecaethyleneoxycetanol, polyoxyethylene sorbitol monooleate, and polyoxyethylene sorbitan monooleate, respectively). Known emulsifying agents include, but are not limited to, lecithin, and acacia. Known preservatives include, but are not limited to, methyl, ethyl, or n-propyl-para-hydroxybenzoates, ascorbic acid, and sorbic acid. Known sweetening agents include, for example, glycerol, propylene glycol, sorbitol, sucrose, and saccharin. Known thickening agents for oily suspensions include, for example, beeswax, hard paraffin, and cetyl alcohol.

In some embodiments, liquid solutions of the targeted lipid particles of the disclosure in aqueous or oily solvents may be prepared in substantially the same manner as liquid suspensions, the primary difference being that the targeted lipid particles of the disclosure is dissolved, rather than suspended in the solvent. As used herein, an "oily" liquid is one which comprises a carbon-containing liquid molecule and which exhibits a less polar character than water. In some embodiments, liquid solutions of the pharmaceutical composition of the disclosure may comprise each of the components described with regard to liquid suspensions, it being understood that suspending agents will not necessarily aid dissolution of the targeted lipid particles of the disclosure in the solvent. In some embodiments, aqueous solvents include, for example, water, and isotonic saline. In some embodiments, oily solvents include, for example, almond oil, oily esters, ethyl alcohol, vegetable oils such as arachis, olive, sesame, or coconut oil, fractionated vegetable oils, and mineral oils such as liquid paraffin.

In some embodiments, powdered and granular formulations of a pharmaceutical preparation of the disclosure may be prepared using known methods. In some embodiments, formulations may be administered directly to a subject, used, for example, to form tablets, to fill capsules, or to prepare an aqueous or oily suspension or solution by addition of an aqueous or oily vehicle thereto. In some of any embodiments, formulations may further comprise one or more of dispersing or wetting agent, a suspending agent, and a preservative. Additional excipients, such as fillers and sweetening, flavoring, or coloring agents, may also be included in these formulations.

In some embodiments, a pharmaceutical composition of the disclosure may also be prepared, packaged, or sold in the form of oil-in-water emulsion or a water-in-oil emulsion. In some embodiments, the oily phase may be a vegetable oil such as olive or arachis oil, a mineral oil such as liquid paraffin, or a combination of these. In some embodiments, compositions further comprise one or more emulsifying agents such as naturally occurring gums such as gum acacia or gum tragacanth, naturally-occurring phosphatides such as soybean or lecithin phosphatide, esters or partial esters derived from combinations of fatty acids and hexitol anhydrides such as sorbitan monooleate, and condensation products of such partial esters with ethylene oxide such as polyoxyethylene sorbitan monooleate. In some embodiments, emulsions may also contain additional ingredients including, for example, sweetening or flavoring agents.

Methods of Treatment

Provided herein are methods of administering a lentiviral vector comprising a CD8 binding agent to a subject. In some embodiments the method comprises a) obtaining whole blood from the subject; b) collecting the fraction of blood containing leukocyte components including CD8+ T cells; c) contacting the leukocyte components including CD8+ T cells with a composition comprising the lentiviral vector to create a transfection mixture; and d) reinfusing the contacted leukocyte components including CD8+ T cells and/or the transfection mixture to the subject, thereby administering the lipid particle and/or payload gene to the subject. In some embodiments, the T cells (e.g. CD8+ T cells) are not activated during the method. In some embodiments, step (c) of the method is carried out for no more than 24 hours, e.g., no more than 20, 16, 12, 8, 6, 5, 4, 3, 2, or 1 hour.

In some embodiments, the method according to the present disclosure is capable of delivering a lentiviral particle to an ex vivo system. The method includes the use of a combination of various apheresis machine hardware components, a software control module, and a sensor module to measure citrate or other solute levels in-line to ensure the maximum accuracy and safety of treatment prescriptions, and the use of replacement fluids designed to fully exploit the design of the system according to the present methods. It is understood that components described for one system according to the present invention can be implemented within other systems according to the present invention as well.

In some embodiments, the method for administration of the lentiviral vector to the subject comprises the use of a blood processing set for obtaining whole blood from the subject, a separation chamber for collecting the fraction of blood containing leukocyte components including CD8+ T cells, a contacting container for contacting the CD8+ T cells with the composition comprising the lentiviral vector, and a further fluid circuit for reinfusion of CD8+ T cells to the patient. In some embodiments, the method further comprises any of i) a washing component for concentrating T cells, and ii) a sensor and/or module for monitoring cell density and/or concentration. In some embodiments, the methods allow processing of blood directly from the patient, transduction with the lentiviral vector, and reinfusion directly to the patient without any steps of selection for T cells or for CD8+ T cells. Further, in some embodiments the methods are carried out without cryopreserving or freezing any cells before or between any one or more of the steps, such that there is no step of formulating cells with a cryoprotectant, e.g. DMSO. In some embodiments, the provided methods do not include a lymphodepletion regimen. In some embodiments, the method including steps (a)-(d) are carried out for a time of no more than 24 hours, such as between 2 hours and 12 hours, for example 3 hours to 6 hours.

In some embodiments, the method is performed in-line (or in situ). In some embodiments, the method is performed in a closed fluid circuit, or a functionally closed fluid circuit. In some embodiments, each of steps (a)-(d) are performed in-line in a closed fluid circuit in which all parts of the system are operably connected, such as via at least one tubing line. In some embodiments, the system is sterile. In some embodiments, the closed fluid circuit is sterile.

Figure 14:
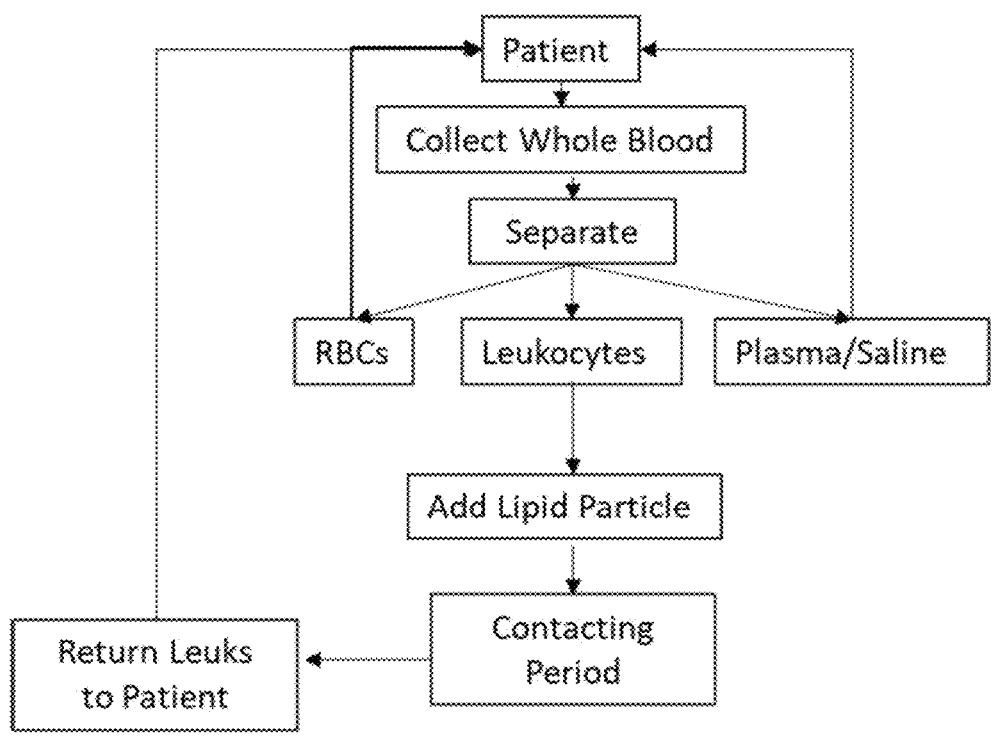

Also provided herein are systems for administration of a lentiviral vector comprising a CD8 binding agent to a subject. An exemplary system for administration is shown in FIG. 14.

In some embodiments, the targeted lipid particles (e.g. targeted viral vectors) provided herein, or pharmaceutical compositions thereof as described herein can be administered to a subject, e.g. a mammal, e.g. a human. In such embodiments, the subject may be at risk of, may have a symptom of, or may be diagnosed with or identified as having, a particular disease or condition. In one embodiment, the subject has cancer. In one embodiment, the subject has an infectious disease. In some embodiments, the targeted viral vector contains nucleic acid sequences encoding an exogenous agent for treating the disease or condition in the subject. For example, the exogenous agent is one that targets or is specific for a protein of a neoplastic cells and the targeted lipid particle is administered to a subject for treating a tumor or cancer in the subject. In another example, the exogenous agent is an inflammatory mediator or immune molecule, such as a cytokine, and targeted lipid particle is administered to a subject for treating any condition in which it is desired to modulate (e.g., increase) the immune response, such as a cancer or infectious disease. In some embodiments, the targeted viral vector is administered in an effective amount or dose to effect treatment of the disease, condition or disorder. Provided herein are uses of any of the provided targeted viral vector in such methods and treatments, and in the preparation of a medicament in order to carry out such therapeutic methods. In some embodiments, the methods are carried out by administering the targeted viral vector or compositions comprising the same, to the subject having, having had, or suspected of having the disease or condition or disorder. In some embodiments, the methods thereby treat the disease or condition or disorder in the subject. Also provided herein are uses of any of the compositions, such as pharmaceutical compositions provided herein, for the treatment of a disease, condition or disorder associated with a particular gene or protein targeted by or provided by the exogenous agent.

In some embodiments, the provided methods or uses involve administration of a pharmaceutical composition comprising oral, inhaled, transdermal or parenteral (including intravenous, intratumoral, intraperitoneal, intramuscular, intracavity, and subcutaneous) administration. In some embodiments, the targeted viral vector may be administered alone or formulated as a pharmaceutical composition. In some embodiments, the targeted viral vector or compositions described herein can be administered to a subject, e.g., a mammal, e.g., a human. In some of any embodiments, the subject may be at risk of, may have a symptom of, or may be diagnosed with or identified as having, a particular disease or condition (e.g., a disease or condition described herein). In some embodiments, the disease is a disease or disorder. In some embodiments, the disease is a B cell malignancy.

In some embodiments, the targeted viral vectors may be administered in the form of a unit-dose composition, such as a unit dose oral, parenteral, transdermal, or inhaled composition. In some embodiments, the compositions are prepared by admixture and are adapted for oral, inhaled, transdermal, or parenteral administration, and as such may be in the form of tablets, capsules, oral liquid preparations, powders, granules, lozenges, reconstitutable powders, injectable, and infusable solutions or suspensions, or suppositories or aerosols.

In some embodiments, the regimen of administration may affect what constitutes an effective amount. In some embodiments, the therapeutic formulations may be administered to the subject either prior to or after a diagnosis of disease. In some embodiments, several divided dosages, as well as staggered dosages may be administered daily or sequentially, or the dose may be continuously infused, or may be a bolus injection. In some embodiments, the dosages of the therapeutic formulations may be proportionally increased or decreased as indicated by the exigencies of the therapeutic or prophylactic situation.

In some embodiments, the administration of the compositions of the present disclosure to a subject, preferably a mammal, more preferably a human, may be carried out using known procedures, at dosages and for periods of time effective to prevent or treat disease. In some embodiments, an effective amount of the targeted lipid particle of the disclosure necessary to achieve a therapeutic effect may vary according to factors such as the activity of the particular lipid particle employed; the time of administration; the rate of excretion; the duration of the treatment; other drugs, compounds or materials used in combination with the targeted lipid particle of the disclosure; the state of the disease or disorder, age, sex, weight, condition, general health and prior medical history of the subject being treated, and like factors well-known in the medical arts. In some embodiments, the dosage regimens may be adjusted to provide the optimum therapeutic response. In some embodiments, several divided doses may be administered daily or the dose may be proportionally reduced as indicated by the exigencies of the therapeutic situation. One of ordinary skill in the art would be able to study the relevant factors and make the determination regarding the effective amount of the therapeutic targeted lipid particle of the disclosure without undue experimentation.

In some embodiments, dosage levels of the targeted lipid particles in the pharmaceutical compositions of this disclosure may be varied so as to obtain an amount that is effective to achieve the desired therapeutic response for a particular subject, composition, and mode of administration, without being toxic to the subject.

A medical doctor, e.g., physician or veterinarian, having ordinary skill in the art may readily determine and prescribe the effective amount of the pharmaceutical composition required. In some embodiments, the physician or veterinarian could start doses of the targeted lipid particles of the disclosure employed in the pharmaceutical composition at levels lower than that required in order to achieve the desired therapeutic effect and gradually increase the dosage until the desired effect is achieved.

In some embodiments, the term "container" includes any receptacle for holding the pharmaceutical composition. In some embodiments, the container is the packaging that contains the pharmaceutical composition. In other embodiments, the container is not the packaging that contains the pharmaceutical composition, i.e., the container is a receptacle, such as a box or vial that contains the packaged pharmaceutical composition or unpackaged pharmaceutical composition and the instructions for use of the pharmaceutical composition. It should be understood that the instructions for use of the pharmaceutical composition may be contained on the packaging containing the pharmaceutical composition, and as such the instructions form an increased functional relationship to the packaged product. In some embodiments, instructions may contain information pertaining to the pharmaceutical composition's ability to perform its intended function, e.g., treating or preventing a disease in a subject, or delivering an imaging or diagnostic agent to a subject.

In some embodiments, routes of administration of any of the compositions disclosed herein include oral, nasal, rectal, parenteral, sublingual, transdermal, transmucosal (e.g., sublingual, lingual, (trans)buccal, (trans)urethral, vaginal (e.g., trans- and perivaginally), (intra)nasal, and (trans)rectal), intravesical, intrapulmonary, intraduodenal, intragastrical, intrathecal, subcutaneous, intramuscular, intradermal, intraarterial, intravenous, intrabronchial, inhalation, and topical administration.

In some of any embodiments, suitable compositions and dosage forms include, for example, tablets, capsules, caplets, pills, gel caps, troches, dispersions, suspensions, solutions, syrups, granules, beads, transdermal patches, gels, powders, pellets, magmas, lozenges, creams, pastes, plasters, lotions, discs, suppositories, liquid sprays for nasal or oral administration, dry powder or aerosolized formulations for inhalation, compositions and formulations for intravesical administration, and the like.

In some embodiments, the targeted lipid particle composition comprising an exogenous agent or cargo, may be used to deliver such exogenous agent or cargo to a cell tissue or subject. In some embodiments, delivery of a cargo by administration of a targeted lipid particle composition described herein may modify cellular protein expression levels. In certain embodiments, the administered composition directs upregulation (via expression in the cell, delivery in the cell, or induction within the cell) of one or more cargo (e.g., a polypeptide or mRNA) that provide a functional activity which is substantially absent or reduced in the cell in which the polypeptide is delivered. In some embodiments, the missing functional activity may be enzymatic, structural, or regulatory in nature. In some embodiments, the administered composition directs up-regulation of one or more polypeptides that increases (e.g., synergistically) a functional activity which is present but substantially deficient in the cell in which the polypeptide is upregulated. In some of any embodiments, the administered composition directs downregulation of (via expression in the cell, delivery in the cell, or induction within the cell) of one or more cargo (e.g., a polypeptide, siRNA, or miRNA) that repress a functional activity which is present or upregulated in the cell in which the polypeptide, siRNA, or miRNA is delivered. In some embodiments, the upregulated functional activity may be enzymatic, structural, or regulatory in nature. In some embodiments, the administered composition directs downregulation of one or more polypeptides that decreases (e.g., synergistically) a functional activity which is present or upregulated in the cell in which the polypeptide is downregulated. In some embodiments, the administered composition directs upregulation of certain functional activities and downregulation of other functional activities.

In some of any embodiments, the targeted lipid particle composition (e.g., one comprising mitochondria or DNA) mediates an effect on a target cell, and the effect lasts for at least 1, 2, 3, 4, 5, 6, or 7 days, 2, 3, or 4 weeks, or 1, 2, 3, 6, or 12 months. In some embodiments (e.g., wherein the targeted viral vector composition comprises an exogenous protein), the effect lasts for less than 1, 2, 3, 4, 5, 6, or 7 days, 2, 3, or 4 weeks, or 1, 2, 3, 6, or 12 months.

In some of any embodiments, the targeted lipid particle composition described herein is delivered ex-vivo to a cell or tissue, e.g., a human cell or tissue. In embodiments, the composition improves function of a cell or tissue ex-vivo, e.g., improves cell viability, respiration, or other function (e.g., another function described herein).

In some embodiments, the composition is delivered to an ex vivo tissue that is in an injured state (e.g., from trauma, disease, hypoxia, ischemia or other damage).

In some embodiments, the composition is delivered to an ex-vivo transplant (e.g., a tissue explant or tissue for transplantation, e.g., a human vein, a musculoskeletal graft such as bone or tendon, cornea, skin, heart valves, nerves; or an isolated or cultured organ, e.g., an organ to be transplanted into a human, e.g., a human heart, liver, lung, kidney, pancreas, intestine, thymus, eye). In some embodiments, the composition is delivered to the tissue or organ before, during and/or after transplantation.

In some embodiments, the composition is delivered, administered, or contacted with a cell, e.g., a cell preparation. In some embodiments, the cell preparation may be a cell therapy preparation (a cell preparation intended for administration to a human subject). In embodiments, the cell preparation comprises cells expressing a T-cell receptor (TCR) or chimeric antigen receptor (CAR), e.g., expressing a recombinant CAR. The cells expressing the CAR may be, e.g., T cells, Natural Killer (NK) cells, cytotoxic T lymphocytes (CTL), regulatory T cells. In embodiments, the cell preparation is a neural stem cell preparation. In embodiments, the cell preparation is a mesenchymal stem cell (MSC) preparation. In embodiments, the cell preparation is a hematopoietic stem cell (HSC) preparation. In embodiments, the cell preparation is an islet cell preparation.

In some embodiments, the viral vector comprising an anti-CD8 sdAb or scFv composition described herein is used to deliver a CAR or TCR. In some embodiments, the viral vector transduces a cell expressing CD8 (e.g., a CD8+ T cell) and expresses and amplifies the CAR or TCR. The amplified CAR or TCR T cells then mediate targeted cell killing. Thus, the disclosure includes the use of viral vector comprising an anti-CD8 scFv fusogen construct to elicit an immune response specific to the antigen binding moiety of the CAR or TCR. In some embodiments, the CAR is used to target a tumor antigen selected from CD19, CD20, CD22, or BCMA. In another embodiment, the CAR is engineered to comprise an intracellular signaling domain of the T cell antigen receptor complex zeta chain (e.g., CD3 zeta). In a preferred embodiment, the intracellular domain is selected from a CD137 (4-1 BB) signaling domain, a CD28 signaling domain, and a CD3zeta signaling domain.

Engineered Receptor Payloads

In some embodiments, the targeted lipid particles (e.g. targeted viral vectors) disclosed herein encode an engineered receptor. In some embodiments, the cells for use in or administered in connection with the provided methods contain or are engineered to contain an engineered receptor, e.g., an engineered antigen receptor, such as a chimeric antigen receptor (CAR). Also provided are populations of such cells, compositions containing such cells and/or enriched for such cells, such as in which cells of a certain type such as T cells or CD8+ cells are enriched or selected. Among the compositions are pharmaceutical compositions and formulations for administration, such as for adoptive cell therapy. Also provided are therapeutic methods for administering the cells and compositions to subjects, e.g., patients, in accord with the provided methods, and/or with the provided articles of manufacture or compositions.

In some embodiments, gene transfer is accomplished without first stimulating the cells, such as by combining it with a stimulus that induces a response such as proliferation, survival, and/or activation, e.g., as measured by expression of a cytokine or activation marker, followed by introduction of the nucleic acids, e.g., by transduction, into the stimulated cells, and optionally incubation or expansion in culture to numbers sufficient for clinical applications.

The viral vectors may express recombinant receptors, such as antigen receptors including chimeric antigen receptors (CARs), and other antigen-binding receptors such as transgenic T cell receptors (TCRs). Also among the receptors are other chimeric receptors.

a. Chimeric Antigen Receptors (CARs)

In some embodiments of the provided methods and uses, chimeric receptors, such as a CARs, contain one or more domains that combine an antigen- or ligand-binding domain (e.g. antibody or antibody fragment) that provides specificity for a desired antigen (e.g., tumor antigen) with intracellular signaling domains. In some embodiments, the intracellular signaling domain is a stimulating or an activating intracellular domain portion, such as a T cell stimulating or activating domain, providing a primary activation signal or a primary signal. In some embodiments, the intracellular signaling domain contains or additionally contains a costimulatory signaling domain to facilitate effector functions. In some embodiments, chimeric receptors when genetically engineered into immune cells can modulate T cell activity, and, in some cases, can modulate T cell differentiation or homeostasis, thereby resulting in genetically engineered cells with improved longevity, survival and/or persistence in vivo, such as for use in adoptive cell therapy methods.

Exemplary antigen receptors, including CARs, and methods for engineering and introducing such receptors into cells, include those described, for example, in WO200014257, WO2013126726, WO2012/129514, WO2014031687, WO2013/166321, WO2013/071154, WO2013/123061, U.S. patent app. Pub. Nos. US2002131960, US2013287748, US20130149337, U.S. Pat. Nos. 6,451,995, 7,446,190, 8,252,592, 8,339,645, 8,398,282, 7,446,179, 6,410,319, 7,070,995, 7,265,209, 7,354,762, 7,446,191, 8,324,353, and 8,479,118, and European patent app. No. EP2537416, and/or those described by Sadelain et al., Cancer Discov. 2013 April; 3(4): 388-398; Davila et al. (2013) PLoS ONE 8(4): e61338; Turtle et al., Curr. Opin. Immunol., 2012 October; 24(5): 633-39; Wu et al., Cancer, 2012 Mar. 18(2): 160-75. In some aspects, the antigen receptors include a CAR as described in U.S. Pat. No. 7,446,190, and those described in WO/2014055668.

Examples of the CARs include CARs as disclosed in any of the aforementioned publications, such as WO2014031687, U.S. Pat. Nos. 8,339,645, 7,446,179, US 2013/0149337, U.S. Pat. Nos. 7,446,190, 8,389,282, Kochenderfer et al., (2013) Nature Reviews Clinical Oncology, 10, 267-276; Wang et al. (2012) J. Immunother. 35(9): 689-701; and Brentjens et al., Sci Transl Med. 2013 5(177). See also WO2014031687, U.S. Pat. Nos. 8,339,645, 7,446,179, US 2013/0149337, U.S. Pat. Nos. 7,446,190, and 8,389,282. The recombinant receptors, such as CARs, generally include an extracellular antigen binding domain, such as a portion of an antibody molecule, generally a variable heavy (VH) chain region and/or variable light (VL) chain region of the antibody, e.g., an scFv antibody fragment. In some embodiments, the antigen binding domain of the CAR molecule comprises an antibody, an antibody fragment, an scFv, a Fv, a Fab, a (Fab')2, a single domain antibody (SdAb), a VH or VL domain, or a camelid VHH domain.

In some embodiments, the antigen targeted by the receptor is a polypeptide. In some embodiments, it is a carbohydrate or other molecule. In some embodiments, the antigen is selectively expressed or overexpressed on cells of the disease or condition, e.g., the tumor or pathogenic cells, as compared to normal or non-targeted cells or tissues. In other embodiments, the antigen is expressed on normal cells and/or is expressed on the engineered cells.

In some embodiments, the antigen targeted by the receptor includes antigens associated with a B cell malignancy, such as any of a number of known B cell marker. In some embodiments, the antigen targeted by the receptor is CD20, CD19, CD22, ROR1, CD45, CD47, CD21, CD5, CD33, Igkappa, Iglambda, CD79a, CD79b or CD30.

In some embodiments, the chimeric antigen receptor includes an extracellular portion containing an antibody or antibody fragment. In some aspects, the chimeric antigen receptor includes an extracellular portion containing the antibody or fragment and an intracellular signaling domain. In some embodiments, the antibody or fragment includes an scFv.

In some embodiments, the antigen targeted by the antigen-binding domain is CD19. In some aspects, the antigen-binding domain of the recombinant receptor, e.g., CAR, and the antigen-binding domain binds, such as specifically binds or specifically recognizes, a CD19, such as a human CD19. In some embodiments, the scFv contains a VH and a VL derived from an antibody or an antibody fragment specific to CD19. In some embodiments, the antibody or antibody fragment that binds CD19 is a mouse derived antibody such as FMC63 and SJ25C1. In some embodiments, the antibody or antibody fragment is a human antibody, e.g., as described in U.S. Patent Publication No. US 2016/0152723.

In some embodiments, the antigen is CD19. In some embodiments, the scFv contains a VH and a VL derived from an antibody or an antibody fragment specific to CD 19. In some embodiments, the antibody or antibody fragment that binds CD 19 is a mouse derived antibody such as FMC63 and SJ25C1. In some embodiments, the antibody or antibody fragment is a human antibody, e.g., as described in U.S. Patent Publication No. US 2016/0152723.

In some embodiments, the scFv is derived from FMC63. FMC63 generally refers to a mouse monoclonal IgGl antibody raised against Nalm-1 and -16 cells expressing CD19 of human origin (Fing, N. R., et al. (1987). Leucocyte typing III. 302).

In some embodiments, the antigen targeted by the antigen-binding domain is BCMA. In some aspects, the antigen-binding domain of the recombinant receptor, e.g., CAR, and the antigen-binding domain binds, such as specifically binds or specifically recognizes, a BCMA, such as a human BCMA. In some embodiments, the antigen-binding domain is a fully human VH sdAb disclosed in US2020/0138865 (disclosed herein by reference in its entirety), e.g., FHVH74, FHVH32, FHVH33, or FHVH93.

In some embodiments, the CD19 specific CAR includes an anti-CD19 single-chain antibody fragment (scFv), a transmembrane domain such as one derived from human CD8α, a 4-1 BB (CD137) co-stimulatory signaling domain, and a CD3ζ signaling domain. In some embodiments, the CD22 specific CAR includes an anti-CD22 scFv, a transmembrane domain such as one derived from human CD8α, a 4-1 BB (CD137) co-stimulatory signaling domain, and a CD3ζ signaling domain. In some embodiments, the CD19/CD22-bispecific CAR includes an anti-CD19 scFv, an anti-CD22 scFv, a transmembrane domain such as one derived from human CD8α, a 4-1 BB (CD137) co-stimulatory signaling domain, and a CD3ζ signaling domain.

In some embodiments, the CAR comprises a commercial CAR construct carried by a T cell. Non-limiting examples of commercial CAR-T cell based therapies include brexucabtagene autoleucel (TECARTUS®), axicabtagene ciloleucel (YESCARTA®), idecabtagene vicleucel (ABECMA®), lisocabtagene maraleucel (BREYANZI®), tisagenlecleucel (KYMRIAH®), Descartes-08 and Descartes-11 from Cartesian Therapeutics, CTL110 from Novartis, P-BMCA-101 from Poseida Therapeutics, AUTO4 from Autolus Limited, UCARTCS from Cellectis, PBCAR19B and PBCAR269A from Precision Biosci-ences, FT819 from Fate Therapeutics, and CYAD-211 from Clyad Oncology.

In some embodiments, a chimeric antigen receptor (CAR) comprises an antigen binding domain. In some embodiments, the CAR is or comprises a first generation CAR comprising an antigen binding domain, a transmembrane domain, and at least one signaling domain (e.g., one, two or three signaling domains). In some embodiments, the CAR comprises a second generation CAR comprising an antigen binding domain, a transmembrane domain, and at least two signaling domains. In some embodiments, the CAR comprises a third generation CAR comprising an antigen binding domain, a transmembrane domain, and at least three signaling domains. In some embodiments, a fourth generation CAR comprising an antigen binding domain, a transmembrane domain, three or four signaling domains, and a domain which upon successful signaling of the CAR induces expression of a cytokine gene. In some embodiments, the antigen binding domain is or comprises an antibody, an antibody fragment, an scFv or a Fab.

1. Antigen Binding Domain (ABD) Targets an Antigen Characteristic of a Neoplastic or Cancer Cell In some embodiments, the antigen binding domain (ABD) targets an antigen characteristic of a neoplastic cell. In other words, the antigen binding domain targets an antigen expressed by a neoplastic or cancer cell. In some embodiments, the ABD binds a tumor associated antigen. In some embodiments, the antigen characteristic of a neoplastic cell (e.g., antigen associated with a neoplastic or cancer cell) or a tumor associated antigen is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, epidermal growth factor receptors (EGFR) (including ErbB1/EGFR, ErbB2/HER2, ErbB3/HER3, and ErbB4/HER4), fibroblast growth factor receptors (FGFR) (including FGF1, FGF2, FGF3, FGF4, FGF5, FGF6, FGF7, FGF18, and FGF21), vascular endothelial growth factor receptors (VEGFR) (including VEGF-A, VEGF-B, VEGF-C, VEGF-D, and PIGF), RET Receptor and the Eph Receptor Family (including EphA1, EphA2, EphA3, EphA4, EphA5, EphA6, EphA7, EphA8, EphA9, EphA10, EphB1, EphB2. EphB3, EphB4, and EphB6), CXCR1, CXCR2, CXCR3, CXCR4, CXCR6, CCR1, CCR2, CCR3, CCR4, CCR5, CCR6, CCR8, CFTR, CIC-1, CIC-2, CIC-4, CIC-5, CIC-7, CIC-Ka, CIC-Kb, Bestrophins, TMEM16A, GABA receptor, glycin receptor, ABC transporters, NAV1.1, NAV1.2, NAV1.3, NAV1.4, NAV1.5, NAV1.6, NAV1.7, NAV1.8, NAV1.9, sphingosin-1-phosphate receptor (S1P1R), NMDA channel, transmembrane protein, multi-span transmembrane protein, T-cell receptor motifs, T-cell alpha chains, T-cell β chains, T-cell γ chains, T-cell δ chains, CCR7, CD3, CD4, CD5, CD7, CD8, CD11b, CD11c, CD16, CD19, CD20, CD21, CD22, CD25, CD28, CD34, CD35, CD40, CD45RA, CD45RO, CD52, CD56, CD62L, CD68, CD80, CD95, CD117, CD127, CD133, CD137 (4-1 BB), CD163, F4/80, IL-4Ra, Sca-1, CTLA-4, GITR, GARP, LAP, granzyme B, LFA-1, transferrin receptor, NKp46, perforin, CD4+, Th1, Th2, Th17, Th40, Th22, Th9, Tfh, canonical Treg. FoxP3+, Tr1, Th3, Treg17, $T_{RE}G$; CDCP, NT5E, EpCAM, CEA, gpA33, mucins, TAG-72, carbonic anhydrase IX, PSMA, folate binding protein, gangliosides (e.g., CD2, CD3, GM2), Lewis-$γ^2$, VEGF, VEGFR 1/2/3, αVβ3, α5β1, ErbB1/EGFR, ErbB1/HER2, ErB3, c-MET, IGF1R, EphA3, TRAIL-R1, TRAIL-R2, RANKL, FAP, Tenascin, PDL-1, BAFF, HDAC, ABL, FLT3, KIT, MET, RET, IL-1β, ALK, RANKL, mTOR, CTLA-4, IL-6, IL-6R, JAK3, BRAF, PTCH, Smoothened, PIGF, ANPEP, TIMP1, PLAUR, PTPRJ, LTBR, ANTXR1, folate receptor alpha (FRa), ERBB2 (Her2/neu), EphA2, IL-13Ra2, epidermal growth factor receptor (EGFR), mesothelin, TSHR, CD19, CD123, CD22, CD30, CD171, CS-1, CLL-1, CD33, EGFRvIII, GD2, GD3, BCMA, MUC16 (CA125), L1CAM, LeY, MSLN, IL13Rα1, L1-CAM, Tn Ag, prostate specific membrane antigen (PSMA), ROR1, FLT3, FAP, TAG72, CD38, CD44v6, CEA, EPCAM, B7H3, KIT, interleukin-11 receptor a (IL-11Ra), PSCA, PRSS21, VEGFR2, LewisY, CD24, platelet-derived growth factor receptor-beta (PDGFR-beta), SSEA-4, CD20, MUC1, NCAM, Prostase, PAP, ELF2M, Ephrin B2, IGF-1 receptor, CAIX, LMP2, gp100, bcr-abl, tyrosinase, Fucosyl GM1, sLe, GM3, TGS5, HMWMAA, o-acetyl-GD2, folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-Ia, MAGE-A1, legumain, HPV E6, E7, ETV6-AML, sperm protein 17, XAGE1, Tie 2, MAD-CT-1, MAD-CT-2, major histocompatibility complex class I-related gene protein (MR1), uro-kinase-type plasminogen activator receptor (uPAR), Fos-related antigen 1, p53, p53 mutant, prostein, survivin, telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, androgen receptor, cyclin B1, MYCN, RhoC, TRP-2, CYPIB I, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, IGLL1, a neoantigen, CD133, CD15, CD184, CD24, CD56, CD26, CD29, CD44, HLA-A, HLA-B, HLA-C, (HLA-A,B,C)

CD49f, CD151 CD340, CD200, tkrA, trkB, or trkC, or an antigenic fragment or antigenic portion thereof.

2. ABD Targets an Antigen Characteristic of a T Cell

In some embodiments, the antigen binding domain targets an antigen characteristic of a T cell. In some embodiments, the ABD binds an antigen associated with a T cell. In some instances, such an antigen is expressed by a T cell or is located on the surface of a T cell. In some embodiments, the antigen characteristic of a T cell or the T cell associated antigen is selected from a cell surface receptor, a membrane transport protein (e.g., an active or passive transport protein such as, for example, an ion channel protein, a pore-forming protein, etc.), a transmembrane receptor, a membrane enzyme, and/or a cell adhesion protein characteristic of a T cell. In some embodiments, an antigen characteristic of a T cell may be a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, AKT1; AKT2; AKT3; ATF2; BCL10; CALM1; CD3D (CD3δ); CD3E (CD3ε); CD3G (CD3γ); CD4; CD8; CD28; CD45; CD80 (B7-1); CD86 (B7-2); CD247 (CD3ζ); CTLA-4 (CD152); ELK1; ERK1 (MAPK3); ERK2; FOS; FYN; GRAP2 (GADS); GRB2; HLA-DRA; HLA-DRB1; HLA-DRB3; HLA-DRB4; HLA-DRB5; HRAS; IKBKA (CHUK); IKBKB; IKBKE; IKBKG (NEMO); IL2; ITPR1; ITK; JUN; KRAS2; LAT; LCK; MAP2K1 (MEK1); MAP2K2 (MEK2); MAP2K3 (MKK3); MAP2K4 (MKK4); MAP2K6 (MKK6); MAP2K7 (MKK7); MAP3K1 (MEKK1); MAP3K3; MAP3K4; MAP3K5; MAP3K8; MAP3K14 (NIK); MAPK8 (JNK1); MAPK9 (JNK2); MAPK10 (JNK3); MAPK11 (p38β); MAPK12 (p38γ); MAPK13 (p38δ); MAPK14 (p38α); NCK; NFAT1; NFAT2; NFKB1; NFKB2; NFKBIA; NRAS; PAK1; PAK2; PAK3; PAK4; PIK3C2B; PIK3C3 (VPS34); PIK3CA; PIK3CB; PIK3CD; PIK3R1; PKCA; PKCB; PKCM; PKCQ; PLCY1; PRF1 (Perforin); PTEN; RAC1; RAF1; RELA; SDF1; SHP2; SLP76; SOS; SRC; TBK1; TCRA; TEC; TRAF6; VAV1; VAV2; or ZAP70.

3. ABD Targets an Antigen Characteristic of an Autoimmune or Inflammatory Disorder In some embodiments, the antigen binding domain targets an antigen characteristic of an autoimmune or inflammatory disorder. In some embodiments, the ABD binds an antigen associated with an autoimmune or inflammatory disorder. In some instances, the antigen is expressed by a cell associated with an autoimmune or inflammatory disorder. In some embodiments, the autoimmune or inflammatory disorder is selected from chronic graft-vs-host disease (GVHD), lupus, arthritis, immune complex glomerulonephritis, goodpasture syndrome, uveitis, hepatitis, systemic sclerosis or scleroderma, type I diabetes, multiple sclerosis, cold agglutinin disease, Pemphigus vulgaris, Grave's disease, autoimmune hemolytic anemia, Hemophilia A, Primary Sjogren's Syndrome, thrombotic thrombocytopenia purrpura, neuromyelits optica, Evan's syndrome, IgM mediated neuropathy, cryoglobulinemia, dermatomyositis, idiopathic thrombocytopenia, ankylosing spondylitis, bullous pemphigoid, acquired angioedema, chronic urticarial, antiphospholipid demyelinating polyneuropathy, and autoimmune thrombocytopenia or neutropenia or pure red cell aplasias, while exemplary non-limiting examples of alloimmune diseases include allosensitization (see, for example, Blazar et al., 2015, Am. J. Transplant, 15(4):931-41) or xenosensitization from hematopoietic or solid organ transplantation, blood transfusions, pregnancy with fetal allosensitization, neonatal alloimmune thrombocytopenia, hemolytic disease of the newborn, sensitization to foreign antigens such as can occur with replacement of inherited or acquired deficiency disorders treated with enzyme or protein replacement therapy, blood products, and gene therapy. In some embodiments, the antigen characteristic of an autoimmune or inflammatory disorder is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor. In some embodiments, an antigen binding domain of a CAR binds to a ligand expressed on B cells, plasma cells, or plasmablasts. In some embodiments, an antigen binding domain of a CAR binds to CD10, CD19, CD20, CD22, CD24, CD27, CD38, CD45R, CD138, CD319, BAFFR, BCMA, CD28, TNF, interferon receptors, GM-CSF, ZAP-70, LFA-1, CD3 gamma, CD5 or CD2. See, e.g., US 2003/0077249; WO 2017/058753; WO 2017/058850, the contents of which are herein incorporated by reference.

4. ABD Targets an Antigen Characteristic of Senescent Cells

In some embodiments, the antigen binding domain targets an antigen characteristic of senescent cells, e.g., urokinase-type plasminogen activator receptor (uPAR). In some embodiments, the ABD binds an antigen associated with a senescent cell. In some instances, the antigen is expressed by a senescent cell. In some embodiments, the CAR may be used for treatment or prophylaxis of disorders characterized by the aberrant accumulation of senescent cells, e.g., liver and lung fibrosis, atherosclerosis, diabetes and osteoarthritis.

5. ABD Targets an Antigen Characteristic of an Infectious Disease

In some embodiments, the antigen binding domain targets an antigen characteristic of an infectious disease. In some embodiments, the ABD binds an antigen associated with an infectious disease. In some instances, the antigen is expressed by a cell affected by an infectious disease. In some embodiments, wherein the infectious disease is selected from HIV, hepatitis B virus, hepatitis C virus, Human herpes virus, Human herpes virus 8 (HHV-8, Kaposi sarcoma-associated herpes virus (KSHV)), Human T-lymphotrophic virus-1 (HTLV-1), Merkel cell polyomavirus (MCV), Simian virus 40 (SV40), Epstein-Barr virus, CMV, human papillomavirus. In some embodiments, the antigen characteristic of an infectious disease is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, HIV Env, gpl20, or CD4-induced epitope on HIV-1 Env.

6. ABD Binds to a Cell Surface Antigen of a Cell

In some embodiments, an antigen binding domain binds to a cell surface antigen of a cell. In some embodiments, a cell surface antigen is characteristic of (e.g., expressed by) a particular or specific cell type. In some embodiments, a cell surface antigen is characteristic of more than one type of cell.

In some embodiments, a CAR antigen binding domain binds a cell surface antigen characteristic of a T cell, such as a cell surface antigen on a T cell. In some embodiments, an antigen characteristic of a T cell may be a cell surface receptor, a membrane transport protein (e.g., an active or passive transport protein such as, for example, an ion channel protein, a pore-forming protein, etc.), a transmembrane receptor, a membrane enzyme, and/or a cell adhesion protein characteristic of a T cell. In some embodiments, an antigen characteristic of a T cell may be a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor.

In some embodiments, an antigen binding domain of a CAR binds a T cell receptor. In some embodiments, a T cell receptor may be AKT1; AKT2; AKT3; ATF2; BCL10; CALM1; CD3D (CD3δ); CD3E (CD3ε); CD3G (CD3γ); CD4; CD8; CD28; CD45; CD80 (B7-1); CD86 (B7-2); CD247 (CD3); CTLA-4 (CD152); ELK1; ERK1 (MAPK3); ERK2; FOS; FYN; GRAP2 (GADS); GRB2; HLA-DRA; HLA-DRB1; HLA-DRB3; HLA-DRB4; HLA-DRB5; HRAS; IKBKA (CHUK); IKBKB; IKBKE; IKBKG (NEMO); IL2; ITPR1; ITK; JUN; KRAS2; LAT; LCK; MAP2K1 (MEK1); MAP2K2 (MEK2); MAP2K3 (MKK3); MAP2K4 (MKK4); MAP2K6 (MKK6); MAP2K7 (MKK7); MAP3K1 (MEKK1); MAP3K3; MAP3K4; MAP3K5; MAP3K8; MAP3K14 (NIK); MAPK8 (JNK1); MAPK9 (JNK2); MAPK10 (JNK3); MAPK11 (p38β); MAPK12 (p38γ); MAPK13 (p38δ); MAPK14 (p38α); NCK; NFAT1; NFAT2; NFKB1; NFKB2; NFKBIA; NRAS; PAK1; PAK2; PAK3; PAK4; PIK3C2B; PIK3C3 (VPS34); PIK3CA; PIK3CB; PIK3CD; PIK3R1; PKCA; PKCB; PKCM; PKCQ; PLCY1; PRF1 (Perforin); PTEN; RAC1; RAF1; RELA; SDF1; SHP2; SLP76; SOS; SRC; TBK1; TCRA; TEC; TRAF6; VAV1; VAV2; or ZAP70.

7. Transmembrane Domain

In some embodiments, the CAR transmembrane domain comprises at least a transmembrane region of the alpha, beta or zeta chain of a T cell receptor, CD28, CD3 epsilon, CD45, CD4, CD5, CD8, CD9, CD16, CD22, CD33, CD37, CD64, CD80, CD86, CD134, CD137, CD154, or functional variant thereof. In some embodiments, the transmembrane domain comprises at least a transmembrane region(s) of CD8α, CD8β, 4-1BB/CD137, CD28, CD34, CD4, FcεRIγ, CD16, OX40/CD134, CD3ζ, CD3ε, CD3γ, CD3δ, TCRα, TCRβ, TCRζ, CD32, CD64, CD64, CD45, CD5, CD9, CD22, CD37, CD80, CD86, CD40, CD40L/CD154, VEGFR2, FAS, and FGFR2B, or functional variant thereof. antigen binding domain binds

8. Signaling Domain or Plurality of Signaling Domains

In some embodiments, a CAR described herein comprises one or at least one signaling domain selected from one or more of B7-1/CD80; B7-2/CD86; B7-H1/PD-L1; B7-H2; B7-H3; B7-H4; B7-H6; B7-H7; BTLA/CD272; CD28; CTLA-4; Gi24/VISTA/B7-H5; ICOS/CD278; PD-1; PD-L2/B7-DC; PDCD6); 4-1 BB/TNFSF9/CD137; 4-1 BB Ligand/TNFSF9; BAFF/BLyS/TNFSF13B; BAFF R/TNFRSF13C; CD27/TNFRSF7; CD27 Ligand/TNFSF7; CD30/TNFRSF8; CD30 Ligand/TNFSF8; CD40/TNFRSF5; CD40/TNFSF5; CD40 Ligand/TNFSF5; DR3/TNFRSF25; GITR/TNFRSF18; GITR Ligand/TNFSF18; HVEM/TNFRSF14; LIGHT/TNFSF14; Lymphotoxin-alpha/TNF-beta; OX40/TNFRSF4; OX40 Ligand/TNFSF4; RELT/TNFRSF19L; TACI/TNFRSF13B; TL1A/TNFSF15; TNF-alpha; TNF RII/TNFRSF1B); 2B4/CD244/SLAMF4; BLAME/SLAMF8; CD2; CD2F-10/SLAMF9; CD48/SLAMF2; CD58/LFA-3; CD84/SLAMF5; CD229/SLAMF3; CRACC/SLAMF7; NTB-A/SLAMF6; SLAM/CD150); CD2; CD7; CD53; CD82/Kai-1; CD90/Thy1; CD96; CD160; CD200; CD300a/LMIR1; HLA Class I; HLA-DR; Ikaros; Integrin alpha 4/CD49d; Integrin alpha 4 beta 1; Integrin alpha 4 beta 7/LPAM-1; LAG-3; TCL1A; TCL1B; CRTAM; DAP12; Dectin-1/CLEC7A; DPPIV/CD26; EphB6; TIM-1/KIM-1/HAVCR; TIM-4; TSLP; TSLP R; lymphocyte function associated antigen-1 (LFA-1); NKG2C, a CD3 zeta domain, an immunoreceptor tyro-sine-based activation motif (ITAM), CD27, CD28, 4-1 BB, CD134/OX40, CD30, CD40, PD-1, ICOS, lymphocyte function-associated antigen-1 (LFA-1), CD2, CD7, LIGHT, NKG2C, B7-H3, a ligand that specifically binds with CD83, or functional fragment thereof.

In some embodiments, the at least one signaling domain comprises a CD3 zeta domain or an immunoreceptor tyrosine-based activation motif (ITAM), or functional variant thereof. In other embodiments, the at least one signaling domain comprises (i) a CD3 zeta domain, or an immunoreceptor tyrosine-based activation motif (ITAM), or functional variant thereof; and (ii) a CD28 domain, or a 4-1 BB domain, or functional variant thereof. In yet other embodiments, the at least one signaling domain comprises a (i) a CD3 zeta domain, or an immunoreceptor tyrosine-based activation motif (ITAM), or functional variant thereof; (ii) a CD28 domain or functional variant thereof; and (iii) a 4-1 BB domain, or a CD134 domain, or functional variant thereof. In some embodiments, the at least one signaling domain comprises a (i) a CD3 zeta domain, or an immunoreceptor tyrosine-based activation motif (ITAM), or functional variant thereof; (ii) a CD28 domain or functional variant thereof; (iii) a 4-1 BB domain, or a CD134 domain, or functional variant thereof; and (iv) a cytokine or costimulatory ligand transgene.

In some embodiments, the at least two signaling domains comprise a CD3 zeta domain or an immunoreceptor tyrosine-based activation motif (ITAM), or functional variant thereof. In other embodiments, the at least two signaling domains comprise (i) a CD3 zeta domain, or an immunoreceptor tyrosine-based activation motif (ITAM), or functional variant thereof; and (ii) a CD28 domain, or a 4-1 BB domain, or functional variant thereof.

In yet other embodiments, the at least one signaling domain comprises a (i) a CD3 zeta domain, or an immunoreceptor tyrosine-based activation motif (ITAM), or functional variant thereof; (ii) a CD28 domain or functional variant thereof; and (iii) a 4-1 BB domain, or a CD134 domain, or functional variant thereof. In some embodiments, the at least two signaling domains comprise a (i) a CD3 zeta domain, or an immunoreceptor tyrosine-based activation motif (ITAM), or functional variant thereof; (ii) a CD28 domain or functional variant thereof; (iii) a 4-1 BB domain, or a CD134 domain, or functional variant thereof; and (iv) a cytokine or costimulatory ligand transgene.

In some embodiments, the at least three signaling domains comprise a CD3 zeta domain or an immunoreceptor tyrosine-based activation motif (ITAM), or functional variant thereof. In other embodiments, the at least three signaling domains comprise (i) a CD3 zeta domain, or an immunoreceptor tyrosine-based activation motif (ITAM), or functional variant thereof; and (ii) a CD28 domain, or a 4-1 BB domain, or functional variant thereof. In yet other embodiments, the least three signaling domains comprises a (i) a CD3 zeta domain, or an immunoreceptor tyrosine-based activation motif (ITAM), or functional variant thereof; (ii) a CD28 domain or functional variant thereof; and (iii) a 4-1 BB domain, or a CD134 domain, or functional variant thereof. In some embodiments, the at least three signaling domains comprise a (i) a CD3 zeta domain, or an immunoreceptor tyrosine-based activation motif (ITAM), or functional variant thereof; (ii) a CD28 domain or functional variant thereof; (iii) a 4-1 BB domain, or a CD134 domain, or functional variant thereof; and (iv) a cytokine or costimulatory ligand transgene.

In some embodiments, the CAR comprises a CD3 zeta domain or an immunoreceptor tyrosine-based activation motif (ITAM), or functional variant thereof. In some embodiments, the CAR comprises (i) a CD3 zeta domain, or an immunoreceptor tyrosine-based activation motif (ITAM), or functional variant thereof; and (ii) a CD28 domain, or a 4-1 BB domain, or functional variant thereof.

In some embodiments, the CAR comprises a (i) a CD3 zeta domain, or an immunoreceptor tyrosine-based activation motif (ITAM), or functional variant thereof; (ii) a CD28 domain or functional variant thereof; and (iii) a 4-1 BB domain, or a CD134 domain, or functional variant thereof.

In some embodiments, the CAR comprises (i) a CD3 zeta domain, or an immunoreceptor tyrosine-based activation motif (ITAM), or functional variant thereof; (ii) a CD28 domain, or a 4-1 BB domain, or functional variant thereof, and/or (iii) a 4-1 BB domain, or a CD134 domain, or functional variant thereof.

In some embodiments, the CAR comprises a (i) a CD3 zeta domain, or an immunoreceptor tyrosine-based activation motif (ITAM), or functional variant thereof; (ii) a CD28 domain or functional variant thereof; (iii) a 4-1BB domain, or a CD134 domain, or functional variant thereof; and (iv) a cytokine or costimulatory ligand transgene.

9. Domain which Upon Successful Signaling of the CAR Induces Expression of a Cytokine Gene In some embodiments, a first, second, third, or fourth generation CAR further comprises a domain which upon successful signaling of the CAR induces expression of a cytokine gene. In some embodiments, a cytokine gene is endogenous or exogenous to a target cell comprising a CAR which comprises a domain which upon successful signaling of the CAR induces expression of a cytokine gene. In some embodiments, a cytokine gene encodes a pro-inflammatory cytokine. In some embodiments, a cytokine gene encodes IL-1, IL-2, IL-9, IL-12, IL-18, TNF, or IFN-gamma, or functional fragment thereof. In some embodiments, a domain which upon successful signaling of the CAR induces expression of a cytokine gene is or comprises a transcription factor or functional domain or fragment thereof. In some embodiments, a domain which upon successful signaling of the CAR induces expression of a cytokine gene is or comprises a transcription factor or functional domain or fragment thereof. In some embodiments, a transcription factor or functional domain or fragment thereof is or comprises a nuclear factor of activated T cells (NFAT), an NF-kB, or functional domain or fragment thereof. See, e.g., Zhang. C. et al., Engineering CAR-T cells. Biomarker Research. 5:22 (2017); WO 2016126608; Sha, H. et al. Chimaeric antigen receptor T-cell therapy for tumour immunotherapy. Bio-science Reports Jan. 27, 2017, 37 (1).

In some embodiments, the CAR further comprises one or more spacers, e.g., wherein the spacer is a first spacer between the antigen binding domain and the transmembrane domain. In some embodiments, the first spacer includes at least a portion of an immunoglobulin constant region or variant or modified version thereof. In some embodiments, the spacer is a second spacer between the transmembrane domain and a signaling domain. In some embodiments, the second spacer is an oligopeptide, e.g., wherein the oligopeptide comprises glycine and serine residues such as but not limited to glycine-serine doublets. In some embodiments, the CAR comprises two or more spacers, e.g., a spacer between the antigen binding domain and the transmembrane domain and a spacer between the transmembrane domain and a signaling domain.

In some embodiments, any one of the cells described herein comprises a nucleic acid encoding a CAR or a first generation CAR. In some embodiments, a first generation CAR comprises an antigen binding domain, a transmembrane domain, and signaling domain. In some embodiments, a signaling domain mediates downstream signaling during T cell activation.

In some embodiments, the methods and compositions disclosed herein comprise a nucleic acid encoding a CAR or a second generation CAR. In some embodiments, a second generation CAR comprises an antigen binding domain, a transmembrane domain, and two signaling domains. In some embodiments, a signaling domain mediates downstream signaling during T cell activation. In some embodiments, a signaling domain is a costimulatory domain. In some embodiments, a costimulatory domain enhances cytokine production, CAR-T cell proliferation, and/or CAR-T cell persistence during T cell activation.

In some embodiments, any one of the compositions and methods described herein comprises a nucleic acid encoding a CAR or a third generation CAR. In some embodiments, a third generation CAR comprises an antigen binding domain, a transmembrane domain, and at least three signaling domains. In some embodiments, a signaling domain mediates downstream signaling during T cell activation. In some embodiments, a signaling domain is a costimulatory domain. In some embodiments, a costimulatory domain enhances cytokine production, CAR-T cell proliferation, and or CAR-T cell persistence during T cell activation. In some embodiments, a third generation CAR comprises at least two costimulatory domains. In some embodiments, the at least two costimulatory domains are not the same.

In some embodiments, any one of the compositions and methods described herein comprises a nucleic acid encoding a CAR or a fourth generation CAR. In some embodiments, a fourth generation CAR comprises an antigen binding domain, a transmembrane domain, and at least two, three, or four signaling domains. In some embodiments, a signaling domain mediates downstream signaling during T cell activation. In some embodiments, a signaling domain is a costimulatory domain. In some embodiments, a costimulatory domain enhances cytokine production, CAR-T cell proliferation, and or CAR-T cell persistence during T cell activation.

10. ABD Comprising an Antibody or Antigen-Binding Portion Thereof.

In some embodiments, a CAR antigen binding domain is or comprises an antibody or antigen-binding portion thereof. In some embodiments, a CAR antigen binding domain is or comprises an scFv or Fab. In some embodiments, a CAR antigen binding domain comprises an scFv or Fab fragment of a CD19 antibody; CD22 antibody; T-cell alpha chain antibody; T-cell β chain antibody; T-cell γ chain antibody; T-cell δ chain antibody; CCR7 antibody; CD3 antibody; CD4 antibody; CD5 antibody; CD7 antibody; CD8 antibody; CD11b antibody; CD11c antibody; CD16 antibody; CD20 antibody; CD21 antibody; CD25 antibody; CD28 antibody; CD34 antibody; CD35 antibody; CD40 antibody; CD45RA antibody; CD45RO antibody; CD52 antibody; CD56 antibody; CD62L antibody; CD68 antibody; CD80 antibody; CD95 antibody; CD117 antibody; CD127 antibody; CD133 antibody; CD137 (4-1 BB) antibody; CD163 antibody; F4/80 antibody; IL-4Ra antibody; Sca-1 antibody; CTLA-4 antibody; GITR antibody GARP antibody; LAP antibody; granzyme B antibody; LFA-1 antibody; MR1 antibody; uPAR antibody; or transferrin receptor antibody.

In some embodiments, a CAR comprises a signaling domain which is a costimulatory domain. In some embodiments, a CAR comprises a second costimulatory domain. In some embodiments, a CAR comprises at least two costimulatory domains. In some embodiments, a CAR comprises at least three costimulatory domains. In some embodiments, a CAR comprises a costimulatory domain selected from one or more of CD27, CD28, 4-1 BB, CD134/OX40, CD30, CD40, PD-1, ICOS, lymphocyte function-associated antigen-1 (LFA-1), CD2, CD7, LIGHT, NKG2C, B7-H3, a ligand that specifically binds with CD83. In some embodiments, if a CAR comprises two or more costimulatory domains, two costimulatory domains are different. In some embodiments, if a CAR comprises two or more costimulatory domains, two costimulatory domains are the same.

In addition to the CARs described herein, various chimeric antigen receptors and nucleotide sequences encoding the same are known in the art and would be suitable for fu-sosomal delivery and reprogramming of target cells in vivo and in vitro as described herein. See, e.g., WO2013040557; WO2012079000; WO2016030414; Smith T, et al., Nature Nanotechnology. 2017. DOI: 10.1038/NNANO.2017.57, the disclosures of which are herein incorporated by reference.

11. Additional Descriptions of CARs

In certain embodiments, the compositions and methods may comprise a polynucleotide encoding a CAR. CARs (also known as chimeric immunoreceptors, chimeric T cell receptors, or artificial T cell receptors) are receptor proteins that have been engineered to give host cells (e.g., T cells) the new ability to target a specific protein. The receptors are chimeric because they combine both antigen-binding and T cell activating functions into a single receptor. The polycistronic vector of the present disclosure may be used to express one or more CARs in a host cell (e.g., a T cell) for use in therapies against various target antigens. The CARs expressed by the one or more expression cassettes may be the same or different. In these embodiments, the CAR may comprise an extracellular binding domain (also referred to as a "binder") that specifically binds a target antigen, a transmembrane domain, and an intracellular signaling domain. In certain embodiments, the CAR may further comprise one or more additional elements, including one or more signal peptides, one or more extracellular hinge domains, and/or one or more intracellular costimulatory domains. Domains may be directly adjacent to one another, or there may be one or more amino acids linking the domains. The nucleotide sequence encoding a CAR may be derived from a mammalian sequence, for example, a mouse sequence, a primate sequence, a human sequence, or combinations thereof. In the cases where the nucleotide sequence encoding a CAR is non-human, the sequence of the CAR may be humanized. The nucleotide sequence encoding a CAR may also be codon-optimized for expression in a mammalian cell, for example, a human cell. In any of these embodiments, the nucleotide sequence encoding a CAR may be at least 80% identical (e.g., at least 80%, at least 85%, at least 90%, at least 95%, at least 96%, at least 97%, at least 98%, at least 99%, or 100% identical) to any of the nucleotide sequences disclosed herein. The sequence variations may be due to codon-optimalization, humanization, restriction enzyme-based cloning scars, and/or additional amino acid residues linking the functional domains, etc.

In certain embodiments, the CAR may comprise a signal peptide at the N-terminus. Non-limiting examples of signal peptides include CD8α signal peptide, IgK signal peptide, and granulocyte-macrophage colony-stimulating factor receptor subunit alpha (GMCSFR-α, also known as colony stimulating factor 2 receptor subunit alpha (CSF2RA)) signal peptide, and variants thereof, the amino acid sequences of which are provided in Table A below.

TABLE A

Exemplary sequences of signal peptides

| SEQ ID NO: | Sequence | Description |
|---|---|---|
| 1106 | MALPVTALLLPLALLLHAARP | CD8α signal peptide |
| 1107 | METDTLLLWVLLLWVPGSTG | IgK signal peptide |
| 1108 | MLLLVTSLLLCELPHPAFLLIP | GMCSFR-α (CSF2RA) signal peptide |
| 1090 | MEFGLSWLFLVAILKGVQCSR | Immunoglobulin heavy chain signal peptide |

In certain embodiments, the extracellular binding domain of the CAR may comprise one or more antibodies specific to one target antigen or multiple target antigens. The antibody may be an antibody fragment, for example, an scFv, or a single-domain antibody fragment, for example, a VHH. In certain embodiments, the scFv may comprise a heavy chain variable region ($V_H$) and a light chain variable region ($V_L$) of an antibody connected by a linker. The $V_H$ and the $V_L$ may be connected in either order, i.e., $V_H$-linker-$V_L$ or $V_L$-linker-$V_H$. Non-limiting examples of linkers include Whitlow linker, $(G_4S)_n$ (n can be a positive integer, e.g., 1, 2, 3, 4, 5, 6, etc.) linker, and variants thereof. In certain embodiments, the antigen may be an antigen that is exclusively or preferentially expressed on tumor cells, or an antigen that is characteristic of an autoimmune or inflammatory disease. Exemplary target antigens include, but are not limited to, CD5, CD19, CD20, CD22, CD23, CD30, CD70, Kappa, Lambda, and B cell maturation agent (BCMA), G-protein coupled receptor family C group 5 member D (GPRC5D) (associated with leukemias); CS1/SLAMF7, CD38, CD138, GPRC5D, TACI, and BCMA (associated with myelomas); GD2, HER2, EGFR, EGFRvIII, B7H3, PSMA, PSCA, CAIX, CD171, CEA, CSPG4, EPHA2, FAP, FRa, IL-13Ra, Mesothelin, MUC1, MUC16, and ROR1 (associated with solid tumors). In any of these embodiments, the extracellular binding domain of the CAR can be codon-optimized for expression in a host cell or have variant sequences to increase functions of the extracellular binding domain.

In certain embodiments, the CAR may comprise a hinge domain, also referred to as a spacer. The terms "hinge" and "spacer" may be used interchangeably in the present disclosure. Non-limiting examples of hinge domains include CD8α hinge domain, CD28 hinge domain, IgG4 hinge domain, IgG4 hinge-CH2-CH3 domain, and variants thereof, the amino acid sequences of which are provided in Table B below.

TABLE B

Exemplary sequences of hinge domains

| SEQ ID NO: | Sequence | Description |
|---|---|---|
| 1109 | TTTPAPRPPTPAPTI-ASQPLSLRPEACRPAAGGAVHTRGLDFACD | CD8α hinge domain |
| 1110 | IEVMYPPPYLDNEKSNGTIIHVKGKHLCPSPLFPGPSKP | CD28 hinge domain |
| 1091 | AAAIEVMYPPPYLDNEKSNGTIIHVKGKHLCPSPLFPGPSKP | CD28 hinge domain |
| 1111 | ESKYGPPCPPCP | IgG4 hinge domain |
| 1112 | ESKYGPPCPSCP | IgG4 hinge domain |
| 1113 | ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | IgG4 hinge-CH2-CH3 domain |

In certain embodiments, the transmembrane domain of the CAR may comprise a transmembrane region of the alpha, beta, or zeta chain of a T cell receptor, CD28, CD3ε, CD45, CD4, CD5, CD8, CD9, CD16, CD22, CD33, CD37, CD64, CD80, CD86, CD134, CD137, CD154, or a functional variant thereof, including the human versions of each of these sequences. In other embodiments, the transmembrane domain may comprise a transmembrane region of CD8α, CD8β, 4-1BB/CD137, CD28, CD34, CD4, FcεRIγ, CD16, OX40/CD134, CD3ζ, CD3ε, CD3γ, CD3δ, TCRα, TCRβ, TCRζ, CD32, CD64, CD64, CD45, CD5, CD9, CD22, CD37, CD80, CD86, CD40, CD40L/CD154, VEGFR2, FAS, and FGFR2B, or a functional variant thereof, including the human versions of each of these sequences. Table C provides the amino acid sequences of a few exemplary transmembrane domains.

TABLE C

Exemplary sequences of transmembrane domains

| SEQ ID NO: | Sequence | Description |
|---|---|---|
| 1114 | IYIWAPLAGTCGVLLLSLVITLYC | CD8α transmembrane domain |
| 1115 | FWVLVVVGGVLACYSLLVTVAFIIFWV | CD28 transmembrane domain |
| 1214 | MFWVLVVVGGVLACYSLLVTVAFII-FWV | CD28 transmembrane domain |

In certain embodiments, the intracellular signaling domain and/or intracellular costimulatory domain of the CAR may comprise one or more signaling domains selected from B7-1/CD80, B7-2/CD86, B7-H1/PD-L1, B7-H2, B7-H3, B7-H4, B7-H6, B7-H7, BTLA/CD272, CD28, CTLA-4, Gi24/VISTA/B7-H5, ICOS/CD278, PD-1, PD-L2/B7-DC, PDCD6, 4-1BB/TNFSF9/CD137, 4-1 BB Ligand/TNFSF9, BAFF/BLyS/TNFSF13B, BAFF R/TNFRSF13C, CD27/TNFRSF7, CD27 Ligand/TNFSF7, CD30/TNFRSF8, CD30 Ligand/TNFSF8, CD40/TNFRSF5, CD40/TNFSF5, CD40 Ligand/TNFSF5, DR3/TNFRSF25, GITR/TNFRSF18, GITR Ligand/TNFSF18, HVEM/TNFRSF14, LIGHT/TNFSF14, Lymphotoxin-alpha/TNFβ, OX40/TNFRSF4, OX40 Ligand/TNFSF4, RELT/TNFRSF19L, TACI/TNFRSF13B, TL1A/TNFSF15, TNFα, TNF RII/TNFRSF1B, 2B4/CD244/SLAMF4, BLAME/SLAMF8, CD2, CD2F-10/SLAMF9, CD48/SLAMF2, CD58/LFA-3, CD84/SLAMF5, CD229/SLAMF3, CRACC/SLAMF7, NTB-A/SLAMF6, SLAM/CD150, CD2, CD7, CD53, CD82/Kai-1, CD90/Thy1, CD96, CD160, CD200, CD300a/LMIR1, HLA Class I, HLA-DR, Ikaros, Integrin alpha 4/CD49d, Integrin alpha 4 beta 1, Integrin alpha 4 beta 7/LPAM-1, LAG-3, TCL1A, TCL1B, CRTAM, DAP12, Dectin-1/CLEC7A, DPPIV/CD26, EphB6, TIM-1/KIM-1/HAVCR, TIM-4, TSLP, TSLP R, lymphocyte function associated antigen-1 (LFA-1), NKG2C, CD3ζ, an immunoreceptor tyrosine-based activation motif (ITAM), CD27, CD28, 4-1 BB, CD134/OX40, CD30, CD40, PD-1, ICOS, lymphocyte function-associated antigen-1 (LFA-1), CD2, CD7, LIGHT, NKG2C, B7-H3, a ligand that specifically binds with CD83, and a functional variant thereof including the human versions of each of these sequences. In some embodiments, the intracellular signaling domain and/or intracellular costimulatory domain comprises one or more signaling domains selected from a CD3 domain, an ITAM, a CD28 domain, 4-1 BB domain, or a functional variant thereof. Table D provides the amino acid sequences of a few exemplary intracellular costimulatory and/or signaling domains. In certain embodiments, as in the case of tisagenlecleucel as described below, the CD3 signaling domain of SEQ ID NO:1118 may have a mutation, e.g., a glutamine (Q) to lysine (K) mutation, at amino acid position 14 (see SEQ ID NO:1215).

TABLE D

Exemplary sequences of intracellular costimulatory and/or signaling domains

| SEQ ID NO: | Sequence | Description |
|---|---|---|
| 1116 | KRGRKKLLY-IFKQPFMRPVQTTQEEDGCSCRF-PEEEEGGCEL | 4-1BB costimulatory domain |
| 1117 | RSKRS-RLLHSDYMNMTPRRPGPTRKHYQPYAPPR DFAAYRS | CD28 costimulatory domain |
| 1091 | RSKRS-RGGHSDYMNMTPRRPGPTRKHYQPYA PPRDFAAYRS | CD28 costimulatory domain (LL > GG mutant) |
| 1118 | RVKFSRSADAPA-YQQGQNQLYNELNLGR-REEYDVLDKRRGRDPEMGGKPRR-KNPQEGLYNEL-QKDKMAEAYSEIGMKGERRRGKGHDGL YQGLSTATKDTYDALHMQALPPR | CD3ζ signaling domain |
| 1215 | RVKFSRSADAPA-YKQGQNQLYNELNLGR-REEYDVLDKRRGRDPEMGGKPRR-KNPQEGLYNEL-QKDKMAEAYSEIGMKGERRRGKGHDGLYQ GLSTATKDTYDALHMQALPPR | CD3ζ signaling domain (with Q to K mutation at position 14) |

In certain embodiments where the polycistronic vector encodes two or more CARs, the two or more CARs may comprise the same functional domains, or one or more different functional domains, as described. For example, the two or more CARs may comprise different signal peptides, extracellular binding domains, hinge domains, transmembrane domains, costimulatory domains, and/or intracellular signaling domains, in order to minimize the risk of recombination due to sequence similarities. Or, alternatively, the two or more CARs may comprise the same domains. In the cases where the same domain(s) and/or backbone are used, it is optional to introduce codon divergence at the nucleotide sequence level to minimize the risk of recombination.

CD19 CAR

In some embodiments, the CAR is a CD19 CAR ("CD19-CAR"), and in these embodiments, the polycistronic vector comprises an expression cassette that contains a nucleotide sequence encoding a CD19 CAR. In some embodiments, the CD19 CAR may comprise a signal peptide, an extracellular binding domain that specifically binds CD19, a hinge domain, a transmembrane domain, an intracellular costimulatory domain, and/or an intracellular signaling domain in tandem.

In some embodiments, the signal peptide of the CD19 CAR comprises a CD8α signal peptide. In some embodiments, the CD8α signal peptide comprises or consists of an amino acid sequence set forth in SEQ ID NO:1106 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1106. In some embodiments, the signal peptide comprises an IgK signal peptide. In some embodiments, the IgK signal peptide comprises or consists of an amino acid sequence set forth in SEQ ID NO:1107 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1107. In some embodiments, the signal peptide comprises a GMCSFR-α or CSF2RA signal peptide. In some embodiments, the GMCSFR-α or CSF2RA signal peptide comprises or consists of an amino acid sequence set forth in SEQ ID NO:1108 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1108.

In some embodiments, the extracellular binding domain of the CD19 CAR is specific to CD19, for example, human CD19. The extracellular binding domain of the CD19 CAR can be codon-optimized for expression in a host cell or to have variant sequences to increase functions of the extracellular binding domain. In some embodiments, the extracellular binding domain comprises an immunogenically active portion of an immunoglobulin molecule, for example, an scFv.

In some embodiments, the extracellular binding domain of the CD19 CAR comprises an scFv derived from the FMC63 monoclonal antibody (FMC63), which comprises the heavy chain variable region ($V_H$) and the light chain variable region ($V_L$) of FMC63 connected by a linker. FMC63 and the derived scFv have been described in Nicholson et al., Mol. Immun. 34(16-17):1157-1165 (1997) and PCT Application Publication No. WO2018/213337, the entire contents of each of which are incorporated by reference herein. In some embodiments, the amino acid sequences of the entire FMC63-derived scFv (also referred to as FMC63 scFv) and its different portions are provided in Table E below. In some embodiments, the CD19-specific scFv comprises or consists of an amino acid sequence set forth in SEQ ID NO:1075, 1119, 1120, or 1125, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO:1075, 1119, 1120, or 1125. In some embodiments, the CD19-specific scFv may comprise one or more CDRs having amino acid sequences set forth in SEQ ID NOs: 1121-1123 and 1126-1128. In some embodiments, the CD19-specific scFv may comprise a light chain with one or more CDRs having amino acid sequences set forth in SEQ ID NOs: 1121-1123. In some embodiments, the CD19-specific scFv may comprise a heavy chain with one or more CDRs having amino acid sequences set forth in SEQ ID NOs: 1126-1128. In any of these embodiments, the CD19-specific scFv may comprise one or more CDRs comprising one or more amino acid substitutions, or comprising a sequence that is at least 80% identical (e.g., at least 80%, at least 85%, at least 90%, at least 95%, at least 96%, at least 97%, at least 98%, at least 99%, or 100% identical), to any of the sequences identified. In some embodiments, the extracellular binding domain of the CD19 CAR comprises or consists of the one or more CDRs as described herein.

In some embodiments, the linker linking the $V_H$ and the $V_L$ portions of the scFv is a Whitlow linker having an amino acid sequence set forth in SEQ ID NO:1124. In some embodiments, the Whitlow linker may be replaced by a different linker, for example, a $3xG_4S$ linker having an amino acid sequence set forth in SEQ ID NO:1130, which gives rise to a different FMC63-derived scFv having an amino acid sequence set forth in SEQ ID NO:1129. In certain of these embodiments, the CD19-specific scFv comprises or consists of an amino acid sequence set forth in SEQ ID NO:1129 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1129.

TABLE E

Exemplary sequences of anti-CD19 scFv and components

| SEQ ID NO: | Amino Acid Sequence | Description |
|---|---|---|
| 1119 | DIQMTQTTSSLSASLGDRVTIS-CRASQDISKY-LNWYQQKPDGTVKLLI-YHTSRLHSGVPSRFSGSGSGTDYS LTISNLEQEDIATYFCQQGN-TLPYTFGGGTKLEIT-GSTSGSGKPGSGEGSTKGEV-KLQESGPGLVAPSQSLSVTCTVSG VSLPDYGVSWIRQP-PRKGLEWLGVIWGSET-TYYNSALKSRLTIIKDNSKSQVFLK-MNSLQTDDTAIYYCAKHYYYGGSY AMDYWGQGTSVTVSS | Anti-CD19 FMC63 scFv entire sequence, with Whitlow linker |
| 1120 | DIQMTQTTSSLSASLGDRVTIS-CRASQDISKY-LNWYQQKPDGTVKLLI-YHTSRLHSGVPSRFSGSGSGTDYS LTISNLEQEDIATYFCQQGN-TLPYTFGGGTKLEIT | Anti-CD19 FMC63 scFv light chain variable region |
| 1121 | QDISKY | Anti-CD19 FMC63 scFv light chain CDR1 |
| 1122 | HTS | Anti-CD19 FMC63 scFv light chain CDR2 |
| 1123 | QQGNTLPYT | Anti-CD19 FMC63 scFv light chain CDR3 |
| 1124 | GSTSGSGKPGSGEGSTKG | Whitlow linker |
| 1125 | EVKLQESGPGLVAP-SQSLSVTCTVSGVSLPDY-GVSWIRQP-PRKGLEWLGVIWGSET-TYYNSALKSRLTIIKDNSKSQVFLKM NSLQTDD-TAIYYCAKHYYYGGSYAMDYWGQ GTSVTVSS | Anti-CD19 FMC63 scFv heavy chain variable region |
| 1126 | GVSLPDYG | Anti-CD19 FMC63 scFv heavy bchain CDR1 |
| 1127 | IWGSETT | Anti-CD19 FMC63 scFv heavy chain CDR2 |
| 1128 | AKHYYYGGSYAMDY | Anti-CD19 FMC63 scFv heavy chain CDR3 |
| 1129 | DIQMTQTTSSLSASLGDRVTIS-CRASQDISKY-LNWYQQKPDGTVKLLI-YHTSRLHSGVPSRFSGSGSGTDYS LTISNLEQEDIATYFCQQGN-TLPYTFGGGTKLEIT-GGGGSGGGGSGGGGSEV-KLQESGPGLVAPSQSLSVTCTVSG VSLPDYGVSWIRQP-PRKGLEWLGVIWGSET-TYYNSALKSRLTIIKDNSKSQVFLK-MNSLQTDDTAIYYCAKHYYYGGSY AMDYWGQGTSVTVSS | Anti-CD19 FMC63 scFv entire sequence, with 3xG$_4$S linker (SEQ ID NO: 1130) |
| 1130 | GGGGSGGGGSGGGGS | 3xG$_4$S linker |

In some embodiments, the extracellular binding domain of the CD19 CAR is derived from an antibody specific to CD19, including, for example, SJ25C1 (Bejcek et al., Cancer Res. 55:2346-2351 (1995)), HD37 (Pezutto et al., J. Immunol. 138(9):2793-2799 (1987)), 4G7 (Meeker et al., Hybridoma 3:305-320 (1984)), B43 (Bejcek (1995)), BLY3 (Bejcek (1995)), B4 (Freedman et al., 70:418-427 (1987)), B4 HB12b (Kansas & Tedder, J. Immunol. 147:4094-4102 (1991); Yazawa et al., Proc. Natl. Acad. Sci. USA 102: 15178-15183 (2005); Herbst et al., J. Pharmacol. Exp. Ther. 335:213-222 (2010)), BU12 (Callard et al., J. Immunology, 148(10): 2983-2987 (1992)), and CLB-CD19 (De Rie Cell. Immunol. 118:368-381(1989))). In any of these embodiments, the extracellular binding domain of the CD19 CAR can comprise or consist of the $V_H$, the $V_L$, and/or one or more CDRs of any of the antibodies.

In some embodiments, the hinge domain of the CD19 CAR comprises a CD8α hinge domain, for example, a human CD8α hinge domain. In some embodiments, the CD8α hinge domain comprises or consists of an amino acid sequence set forth in SEQ ID NO:1109 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1109. In some embodiments, the hinge domain comprises a CD28 hinge domain, for example, a human CD28 hinge domain. In some embodiments, the CD28 hinge domain comprises or consists of an amino acid sequence set forth in SEQ ID NO:1110 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1110. In some embodiments, the hinge domain comprises an IgG4 hinge domain, for example, a human IgG4 hinge domain. In some embodiments, the IgG4 hinge domain comprises or consists of an amino acid sequence set forth in SEQ ID NO:1111 or SEQ ID NO:1112, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1111 or SEQ ID NO: 1112. In some embodiments, the hinge domain comprises a IgG4 hinge-Ch2-Ch3 domain, for example, a human IgG4 hinge-Ch2-Ch3 domain. In some embodiments, the IgG4 hinge-Ch2-Ch3 domain comprises or consists of an amino acid sequence set forth in SEQ ID NO: 1113 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1113. In some embodiments, the transmembrane domain of the CD19 CAR comprises a CD8α transmembrane domain, for example, a human CD8α transmembrane domain. In some embodiments, the CD8α transmembrane domain comprises or consists of an amino acid sequence set forth in SEQ ID NO: 1114 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1114. In some embodiments, the transmembrane domain comprises a CD28 transmembrane domain, for example, a human CD28 transmembrane domain. In some embodiments, the CD28 transmembrane domain comprises or consists of an amino acid sequence set forth in SEQ ID NO: 1115 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1115.

In some embodiments, the intracellular costimulatory domain of the CD19 CAR comprises a 4-1 BB costimulatory domain. 4-1 BB, also known as CD137, transmits a potent costimulatory signal to T cells, promoting differentiation and enhancing long-term survival of T lymphocytes. In some embodiments, the 4-1 BB costimulatory domain is human. In some embodiments, the 4-1 BB costimulatory domain comprises or consists of an amino acid sequence set forth in SEQ ID NO: 1116 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1116. In some embodiments, the intracellular costimulatory domain comprises a CD28 costimulatory domain. CD28 is another co-stimulatory molecule on T cells. In some embodiments, the CD28 costimulatory domain is human. In some embodiments, the CD28 costimulatory domain comprises or consists of an amino acid sequence set forth in SEQ ID NO: 1117 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1117. In some embodiments, the intracellular costimulatory domain of the CD19 CAR comprises a 4-1 BB costimulatory domain and a CD28 costimulatory domain as described.

In some embodiments, the intracellular signaling domain of the CD19 CAR comprises a CD3 zeta (ζ) signaling domain. CD3 associates with T cell receptors (TCRs) to produce a signal and contains immunoreceptor tyrosine-based activation motifs (ITAMs).

The CD3ζ signaling domain refers to amino acid residues from the cytoplasmic domain of the zeta chain that are sufficient to functionally transmit an initial signal necessary for T cell activation. In some embodiments, the CD3ζ signaling domain is human. In some embodiments, the CD3ζ signaling domain comprises or consists of an amino acid sequence set forth in SEQ ID NO: 1118 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1118.

In some embodiments, the polycistronic vector comprises an expression cassette that contains a nucleotide sequence encoding a CD19 CAR, including, for example, a CD19 CAR comprising the CD19-specific scFv having sequences set forth in SEQ ID NO: 1119 or SEQ ID NO: 1129, the CD8α hinge domain of SEQ ID NO:1109, the CD8α transmembrane domain of SEQ ID NO: 1114, the 4-1 BB costimulatory domain of SEQ ID NO: 1116, the CD3 signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof. In any of these embodiments, the CD19 CAR may additionally comprise a signal peptide (e.g., a CD8α signal peptide) as described. In some embodiments, the polycistronic vector comprises an expression cassette that contains a nucleotide sequence encoding a CD19 CAR, including, for example, a CD19 CAR comprising the CD19-specific scFv having sequences set forth in SEQ ID NO: 1119 or SEQ ID NO: 1129, the IgG4 hinge domain of SEQ ID NO:1111 or SEQ ID NO: 1112, the CD28 transmembrane domain of SEQ ID NO:1115, the 4-1 BB costimulatory domain of SEQ ID NO: 1116, the CD3 signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof. In any of these embodiments, the CD19 CAR may additionally comprise a signal peptide (e.g., a CD8α signal peptide) as described.

In some embodiments, the polycistronic vector comprises an expression cassette that contains a nucleotide sequence encoding a CD19 CAR, including, for example, a CD19 CAR comprising the CD19-specific scFv having sequences set forth in SEQ ID NO: 1075, SEQ ID NO: 1119, or SEQ ID NO: 1129, the CD28 hinge domain of SEQ ID NO: 1110, the CD28 transmembrane domain of SEQ ID NO: 1115, the CD28 costimulatory domain of SEQ ID NO: 1117, the CD3 signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof. In any of these embodiments, the CD19 CAR may additionally comprise a signal peptide (e.g., a CD8α signal peptide) as described.

In some embodiments, the polycistronic vector comprises an expression cassette that contains a nucleotide sequence encoding a CD19 CAR comprising the CD19-specific scFv having the sequence set forth in SEQ ID NO: 1075 (see Table 14), the CD8 hinge domain of SEQ ID NO: 1109, the CD8 transmembrane domain of SEQ ID NO: 1114, the 4-1 BB costimulatory domain of SEQ ID NO: 1116, the CD3 signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof. In any of these embodiments, the CD19 CAR may additionally comprise a signal peptide (e.g., a CD8α signal peptide) as described.

In some embodiments, the polycistronic vector comprises an expression cassette that contains a nucleotide sequence encoding a CD19 CAR as set forth in SEQ ID NO: 1216 or is at least 80% identical (e.g., at least 80%, at least 85%, at least 90%, at least 95%, at least 96%, at least 97%, at least 98%, at least 99%, or 100% identical) to the nucleotide sequence set forth in SEQ ID NO: 1216 (see Table F). The encoded CD19 CAR has a corresponding amino acid sequence set forth in SEQ ID NO: 1217 or is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1217, with the following components: CD8α signal peptide, FMC63 scFv ($V_L$-Whitlow linker-$V_H$), CD8α hinge domain, CD8α transmembrane domain, 4-1 BB costimulatory domain, and CD3ζ signaling domain.

In some embodiments, the polycistronic vector comprises an expression cassette that contains a nucleotide sequence encoding a commercially available embodiment of CD19 CAR. Non-limiting examples of commercially available embodiments of CD19 CARs expressed and/or encoded by T cells include tisagenlecleucel, lisocabtagene maraleucel, axicabtagene ciloleucel, and brexucabtagene autoleucel.

In some embodiments, the polycistronic vector comprises an expression cassette that contains a nucleotide sequence encoding tisagenlecleucel or portions thereof. Tisagenlecleucel comprises a CD19 CAR with the following components: CD8α signal peptide, FMC63 scFv ($V_L$-3xG$_4$S linker-VH), CD8α hinge domain, CD8α transmembrane domain, 4-1 BB costimulatory domain, and CD3 signaling domain. The nucleotide and amino acid sequence of the CD19 CAR in tisagenlecleucel are provided in Table F, with annotations of the sequences provided in Table G.

In some embodiments, the polycistronic vector comprises an expression cassette that contains a nucleotide sequence encoding lisocabtagene maraleucel or portions thereof. Lisocabtagene maraleucel comprises a CD19 CAR with the following components: GMCSFR-α or CSF2RA signal peptide, FMC63 scFv ($V_L$-Whitlow linker-$V_H$), IgG4 hinge domain, CD28 transmembrane domain, 4-1 BB costimulatory domain, and CD3ζ signaling domain. The nucleotide and amino acid sequence of the CD19 CAR in lisocabtagene maraleucel are provided in Table F, with annotations of the sequences provided in Table H.

In some embodiments, the polycistronic vector comprises an expression cassette that contains a nucleotide sequence encoding axicabtagene ciloleucel or portions thereof. Axicabtagene ciloleucel comprises a CD19 CAR with the following components: GMCSFR-α or CSF2RA signal peptide, FMC63 scFv ($V_L$-Whitlow linker-VH), CD28 hinge domain, CD28 transmembrane domain, CD28 costimulatory domain, and CD3ζ signaling domain. The nucleotide and amino acid sequence of the CD19 CAR in axicabtagene ciloleucel are provided in Table F, with annotations of the sequences provided in Table I.

In some embodiments, the polycistronic vector comprises an expression cassette that contains a nucleotide sequence encoding brexucabtagene autoleucel or portions thereof. Brexucabtagene autoleucel comprises a CD19 CAR with the following components: GMCSFR-α signal peptide, FMC63 scFv, CD28 hinge domain, CD28 transmembrane domain, CD28 costimulatory domain, and CD3ζ signaling domain.

In some embodiments, the polycistronic vector comprises an expression cassette that contains a nucleotide sequence encoding a CD19 CAR as set forth in SEQ ID NO: 1131, 1133, or 1135, or is at least 80% identical (e.g., at least 80%, at least 85%, at least 90%, at least 95%, at least 96%, at least 97%, at least 98%, at least 99%, or 100% identical) to the nucleotide sequence set forth in SEQ ID NO: 1131, 1133, or 1135. The encoded CD19 CAR has a corresponding amino acid sequence set forth in SEQ ID NO: 1132, 1134, or 1136, respectively, or is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1132, 1134, or 1136, respectively.

TABLE F

Exemplary sequences of CD19 CARs

| SEQ ID NO: | Sequence | Description |
| --- | --- | --- |
| 1216 | atggccttaccagtgaccgccttgctcctgccgctggcctt-gctgctccac-gccgccaggccggacatccagatgacacagactacatc ctccctgtctgcctctctgggagacagagtcaccatcagtt-gcagggcaagtcaggacatt-agtaaatatttaaattggtatcagcagaaaccagatggaa ctgttaaactcctgatctaccatacatcaagattacactcag-gagtcccatcaaggttcag-tggcagtgggtctggaacagattattctctcaccattagcaa cctggagcaagaagatattgccacttactttt-gccaacagggtaatacgcttccgtacac-gttcggaggggggaccaagctggagatcacaggctcca cctctggatccggcaagcccg-gatctggcgagggatccaccaagggcgaggtgaaactg-cag-gagtcaggacctggcctggtggcgccctcacagagcctgt ccgtcacatgcactgtctcaggggtctcattacccgac-tatggtgtaagctggat-tcgccagcctccacgaaagggtctggagtggctgggagt aatatggggtagtgaaaccacatacta-taattcagctctcaaatccagactgac-catcatcaaggacaactccaagagccaagtttttcttaaaa atgaacagtctg-caaactgatgacacagccatttactactgtgccaaacattat tactacggtggtagctatgctatggac-tactggggccaaggaacctcagtcac-cgtctcctcaaccacgacgccagccgccgcgaccaccaa caccggcgcccaccatcgcgtcg-cagcccctgtccctgcgcccagaggcgtgccggccagcg gcggggggcgcagtgcacacgaggggggctg-gacttcgcctgtga-tatctacatctgggcgcccttggccgggacttgtggggtcctt ctcctgtcactggttatcacccctttactgcaaacgggg-cagaaagaaactcctgtata-tattcaaacaaccatttatgagaccagtacaaactactcaa gaggaagatggctgtagctgccgatttccagaagaa-gaagaaggaggatgtgaactgagag-tgaagttcagcaggagcgcagacgccccccgcgtaccag cagggccagaaccagctctataacgagctcaatctag-gacgaagagaggagtacgatgtttt-ggacaagagacgtggccgggaccctgagatggggga aagccgagaaggaagaaccctcaggaaggcctg-tacaatgaactgcagaaagataa- | Exemplary CD19 CAR nucleotide sequence |

TABLE F-continued

Exemplary sequences of CD19 CARs

| SEQ ID NO: | Sequence | Description |
|---|---|---|
| | gatggcggaggcctacagtgagattgggatgaaaggcg agcgccggaggggcaaggggcacgatggcctttac- cagggtctcagtacagccac- caaggacacctacgacgcccttcacatgcaggccctgcc ccctcgc | |
| 1217 | MAL- PVTALLLPLALLLHAARPDIQMTQTTSSLS ASLGDRVTISCRASQDISKY- LNWYQQKPDGTVKLLI- YHTSRLHSGVPSRFSGSGSGTDYS- LTISNLEQEDIATYFCQQGNTLPYTFGGGT KLEITGSTSGSGKPGSGEGSTKGEV- KLQESGPGLVAP- SQSLSVTCTVSGVSLPDY- GVSWIRQPPRKGLEWLGVIWGSETTYYN SALKSRLTIIKDNSKSQVFLKMNSLQTDD- TAIYYCAKHYYYGGSYAMDYWGQGTSVT VSSTTTPAPRPPTPAPTI- ASQPLSLRPEACRPAAGGAVHTRGLD- FACDIYIWAPLAG- TCGVLLLSLVITLYCKRGRKKLLYIFKQPFM RPVQTTQEEDGCSCRFPEEEE- GGCELRVKFSRSADAPA- YQQGQNQLYNELNLGR- REEYDVLDKRRGRDPEMGGKPRRKNPQ EGLYNEL- QKDKMAEAYSEIGMKGERRRGKGH- DGLYQGLSTATKDTYDALHMQALPPR | Exemplary CD19 CAR amino acid sequence |
| 1231 | DIQMTQTTSSLSASLGDRVTIS- CRASQDISKYLNWYQQKPDGTVKLLI- YHTSRLHSGVPSRFSGSGSGTDYSLTISN LEQEDIATYFCQQGN- TLPYTFGGGTKLEIT- GSTSGSGKPGSGEGSTKGEV- KLQESGPGLVAP- SQSLSVTCTVSGVSLPDYGVSWIRQPPRK GLEWLGVIWGSETTYYNSALKSRLTIIK- DNSKSQVFLKMNSLQTDD- TAIYYCAKHYYYGGSYAMDYWGQGTSVT VSSTTTPAPRPPTPAPTI- ASQPLSLRPEACRPAAGGAVHTRGLD- FACDIYIWAPLAG- TCGVLLLSLVITLYCKRGRKKLLYIFKQPFM RPVQTTQEEDGCSCRFPEEEE- GGCELRVKFSRSADAPA- YQQGQNQLYNELNLGR- REEYDVLDKRRGRDPEMGGKPRRKNPQ EGLYNEL- QKDKMAEAYSEIGMKGERRRGKGH- DGLYQGLSTATKDTYDALHMQALPPR | Exemplary CD19 CAR amino acid sequence (no signal sequence) |
| 1131 | atggccttaccagtgaccgccttgctcctgccgctggcctt- gctgctccac- gccgccaggccggacatccagatgacacagactacatc ctccctgtctgcctctctgggagacagagtcaccatcagtt- gcagggcaagtcaggacatt- agtaaatatttaaattggtatcagcagaaaccagatggaa ctgttaaactcctgatctaccatacatcaagattacactcag- gagtcccatcaaggttcag- tggcagtgggtctggaacagattattctctcaccattagcaa cctggagcaagaagatattgccacttacttttt- gccaacagggtaatacgcttccgtacac- gttcggaggggggaccaagctggagatcacaggtggcg gtggctcgggcggtggtgggtcgggtggcggcg- gatctgaggtgaaactgcaggagtcag- gacctggcctggtggcgccctcacagagcctgtccgtcac atgcactgtctcaggggtctcattacccgactatggtgtaa- gctggattcgccagcctcac- gaaagggtctggagtggctgggagtaatatgggtagtga aaccacatactataattcagctctcaaatccagactgac- catcatcaaggacaactccaa- gagccaagttttcttaaaaatgaacagtctgcaaactgatg acacagccatttactactgtgccaaacattattactac- ggtggtagctatgctatggac- | Tisagenlecleucel CD19 CAR nucleotide sequence |

TABLE F-continued

Exemplary sequences of CD19 CARs

| SEQ ID NO: | Sequence | Description |
|---|---|---|
| | tactggggccaaggaacctcagtcaccgtctcctcaacca cgacgccagcgccgcgaccaccaacac- cggcgccaccatcgcgtcg- cagcccctgtccctgcgcccagaggcgtgccggccagcg gcgggggcgcagtgcacacgaggggctg- gacttcgcctgtga- tatctacatctgggcgccttggccgggacttgtggggtcctt ctcctgtcactggttatcacccttactgcaaacgggg- cagaaagaaactcctgtata- tattcaaacaaccatttatgagaccagtacaaactactcaa gaggaagatggctgtagctgccgatttccagaagaa- gaagaaggaggatgtgaactgagag- tgaagttcagcaggagcgcagacgccccgcgtacaag cagggccagaaccagctctataacgagctcaatctag- gacgaagagaggagtacgatgttttt- ggacaagagacgtggccgggaccctgagatgggggga aagccgagaaggaagaaccctcaggaaggcctg- tacaatgaactgcagaaagataa- gatgcggaggcctacagtgagattgggatgaaaggcg agcgccggaggggcaaggggcacgatggcctttac- cagggtctcagtacagccac- caaggacacctacgacgcccttcacatgcaggccctgcc ccctcgc | |
| 1132 | MAL-<br>PVTALLLPLALLLHAARPDIQMTQTTSSLS<br>ASLGDRVTISCRASQDISKY-<br>LNWYQQKPDGTVKLLI-<br>YHTSRLHSGVPSRFSGSGSGTDYS-<br>LTISNLEQEDIATYFCQQGNTLPYTFGGGT<br>KLEITGGGGSGGGGSGGGGSEV-<br>KLQESGPGLVAP-<br>SQSLSVTCTVSGVSLPDYGVSWIRQP-<br>PRKGLEWLGVIWGSETTYYNSALKSRLTII<br>KDNSKSQVFLKMNSLQTDD-<br>TAIYYCAKHYYYGGSYAMDYWGQGTSVT<br>VSSTTTPAPRPPTPAPTI-<br>ASQPLSLRPEACRPAAGGAVHTRGLD-<br>FACDIYIWAPLAG-<br>TCGVLLLSLVITLYCKRGRKKLLYIFKQPFM<br>RPVQTTQEEDGCSCRFPEEEE-<br>GGCELRVKFSRSADAPA-<br>YKQGQNQLYNELNLGR-<br>REEYDVLDKRRGRDPEMGGKPRRKNPQ<br>EGLYNEL-<br>QKDKMAEAYSEIGMKGERRRGKGH-<br>DGLYQGLSTATKDTYDALHMQALPPR | Tisagenlecleucel<br>CD19 CAR<br>amino acid<br>sequence |
| 1133 | atgctgctgctggtgac- cagcctgctgctgtgcgagctgccccaccccgcctttctgct gatccccgacatccagatgacccagaccac- ctccagcctgagcgccagcctgggcgac- cgggtgaccatcagctgccgggccagccaggacatcag caagtacctgaactggtatcagcagaagcccgacgg- caccgtcaagctgctgatctac- cacaccagccggctgcacagcggcgtgcccagccggttt agcggcagcggctccggcaccgactacagcctgac- catctccaacctggaacaggaaga- tatcg ccacctacttttgccagcagggcaacacactgccct acacctttggcggcggaacaaagctggaaatcaccgg- cagcacctccggcagcggcaa- gcctggcagcggcgagggcagcaccaagggcgaggtg aagctgcaggaaa- gcggccctggcctggtggcccccagccagagcctgagcg tgacctgcaccgtgagcggcgtgagcctgcccgactac- ggcgtgagctggatccgg- cagccccccaggaagggcctggaatggctgggcgtgatc tggggcagcgagaccacctactacaacagcgccctgaa- gagccggctgac- catcatcaaggacaacagcaagagccaggtgttcctgaa gatgaacagcctgcagaccgacgacac- cgccatctactactgcgccaagcactactactac- ggcggcagctacgccatggactactggggccagggcac cagcgtgaccgtgagcagcgaatctaagtacggac- cgccctgccccccctt- gccctatgttctgggtgctggtggtggtcggaggcgtgctgg | Lisocabtagene<br>maraleucel<br>CD19 CAR<br>nucleotide<br>sequence |

TABLE F-continued

Exemplary sequences of CD19 CARs

| SEQ ID NO: | Sequence | Description |
|---|---|---|
| | cctgctacagcctgctggtcaccgtggccttcatcatctttt-gggtgaaacggggcagaaa-gaaactcctgtatatattcaaacaaccatttatgagaccagtacaaactactcaagaggaagatggctgtagctgccgat-ttccagaagaagaagaaggag-gatgtgaactgcgggtgaagttcagcagaagcgccgacgcccctgcctaccagcagggccagaatcagctgtacaac-gagctgaacctgggcagaagggaa-gagtacgacgtcctggataagcggaggccgggacctgagatgggcggcaagcctcggcggaagaaccccag-gaaggcctgtataacgaactg-cagaaagacaagatggccgaggcctacagcgagatcggcatgaagggcgagcggaggcggggcaagggccac-gacggcctgtatcagggcctgtccac-cgccaccaaggatacctacgacgccctgcacatgcaggcctgccccaagg | |
| 1134 | MLLLVTSLLLCELPHPAFL-LIPDIQMTQTTSSLSASLGDRVTIS-CRASQDISKY-LNWYQQKPDGTVKLLIYHTSRLHSGVPSRFSGSGSGTDYSLTISNLEQEDIATY-FCQQGNTLPYTFGGGTKLEIT-GSTSGSGKPGSGEGSTKGEVKLQESGPGLVAPSQSLSVTCTVSGVSLPDY-GVSWIRQPPRKGLEWLGVIWGSET-TYYNSALKSRLTIIK-DNSKSQVFLKMNSLQTDDTAIYYCAKHYYGGSYAMDYWGQGTSVTVSSESKYGPPCPPCPMFWVLVVVGGVLACYSLLVTVAFI-IFWVKRGRKKLLY-IFKQPFMRPVQTTQEEDGCSCRFPEEEEGGCELRVKFSRSADAPA-YQQGQNQLYNELNLGR-REEYDVLDKRRGRDPEMGGKPRR-KNPQEGLYNELQKDKMAEAYSEIGMKGERRRGKGHDGLYQGLSTAT-KDTYDALHMQALPPR | Lisocabtagene maraleucel CD19 CAR amino acid sequence |
| 1135 | atgcttctcctggtgacaagccttctgctctgtgagttac-cacacccag-cattcctcctgatcccagacatccagatgacacagactacatcctccctgtctgcctctctgggagacagagtcac-catcagttgcagggcaagtcag-gacattagtaaatatttaaattggtatcagcagaaaccagatggaactgttaaactcctgatctaccatacatcaagat-tacactcaggag-tcccatcaaggttcagtggcagtgggtctggaacagattattctctcaccattagcaacctggagcaagaagatattgccac-ttacttttgccaacagggtaa-tacgcttccgtacacgttcggaggggggactaagttggaaataacaggctccacctctggatccggcaagcccg-gatctggcgagggatccac-caagggcgaggtgaaactgcaggagtcaggacctggcctggtggcgccctcacagagcctgtccgtcacatgcac-tgtctcaggggtctcattacccgac-tatggtgtaagctggattcgccagcctccacgaaagggtctggagtggctgggagtaatatgggtagtgaaac-cacatacta-taattcagctctcaaatccagactgaccatcatcaaggacaactccaagagccaagtttcttaaaaatgaacagtctg-caaactgatgacacagccatttactactgtgccaaacattattactacggtggtagctatgctatggac-tactggggtcaaggaacctcagtcac-cgtctcctcagcggccgcaattgaagttatgtatcctcctccttacctagacaatgagaagagcaatggaac-cattatccatgtgaaagggaaacacctttt-gtccaagtcccctatttcccggaccttctaagccccttttgggtgctggtggtggttgggggagtcctggcttgctatagctt-gctagtaacag-tggcctttattattttctgggtgaggagtaagaggagcaggctcctgcacagtgac-tacatgaacatgactccccgcgccccgggcccacccg-caagcattac-cagccctatgcccaccacgcgacttcgcagcctatcgctccagagtgaagttcagcaggagcgcagac- | Axicabtagene ciloleucel CD19 CAR nucleotide sequence |

TABLE F-continued

Exemplary sequences of CD19 CARs

| SEQ ID NO: | Sequence | Description |
|---|---|---|
|  | gccccgcgtaccagcagggccagaaccagctc-<br>tataacgagctcaatctaggacgaagagaggagtacgat<br>gttttggacaagagacgtggccgggaccctga-<br>gatggggggaaagccgagaaggaa-<br>gaaccctcaggaaggcctgtacaatgaactgcagaaag<br>ataagatggcggaggcctacagtgagattgg-<br>gatgaaaggcgagcgccggaggggcaagggg-<br>cacgatggcctttaccagggtctcagtacagccaccaagg<br>acacctacgac-<br>gcccttcacatgcaggccctgcccctcgc |  |
| 1136 | MLLLVTSLLLCELPHPAFL-<br>LIPDIQMTQTTSSLSASLGDRVTIS-<br>CRASQDISKY-<br>LNWYQQKPDGTVKLLIYHTSRLHSGVPSR<br>FSGSGSGTDYSLTISNLEQEDIATY-<br>FCQQGNTLPYTFGGGTKLEIT-<br>GSTSGSGKPGSGEGSTKGEVKLQESGPG<br>LVAPSQSLSVTCTVSGVSLPDY-<br>GVSWIRQPPRKGLEWLGVIWGSET-<br>TYYNSALKSRLTIIK-<br>DNSKSQVFLKMNSLQTDDTAIYYCAKHYY<br>YGGSYAMDYWGQGTSVTVSSAAAIEVMY<br>PPPYLDNEKSNGTIIHVKGKHLCPSPLF-<br>PGPSKPFWVLVVVGGVLACYSLLVTVAFII-<br>FWVRSKRSRLLHSDYMNMTPRRPGPTRK<br>HYQPYAPPRDFAAYRSRVKFSRSADAPA-<br>YQQGQNQLYNELNLGR-<br>REEYDVLDKRRGRD-<br>PEMGGKPRRKNPQEGLYNELQKDKMAEA<br>YSEIGMKGERRRGKGHDGLYQGLSTAT-<br>KDTYDALHMQALPPR | Axicabtagene ciloleucel CD19 CAR amino acid sequence |

TABLE G

Annotation of tisagenlecleucel CD19 CAR sequences

| Feature | Nucleotide Sequence Position | Amino Acid Sequence Position |
|---|---|---|
| CD8α signal peptide | 1-63 | 1-21 |
| FMC63 scFv ($V_L$-3xG$_4$S linker-$V_H$) | 64-789 | 22-263 |
| CD8a hinge domain | 790-924 | 264-308 |
| CD8α transmembrane domain | 925-996 | 309-332 |
| 4-1BB costimulatory domain | 997-1122 | 333-374 |
| CD3ζ signaling domain | 1123-1458 | 375-486 |

TABLE H

Annotation of lisocabtagene maraleucel CD19 CAR sequences

| Feature | Nucleotide Sequence Position | Amino Acid Sequence Position |
|---|---|---|
| GMCSFR-α signal peptide | 1-66 | 1-22 |
| FMC63 scFv ($V_L$-Whitlow linker-$V_H$) | 67-801 | 23-267 |
| IgG4 hinge domain | 802-837 | 268-279 |
| CD28 transmembrane domain | 838-921 | 280-307 |
| 4-1BB costimulatory domain | 922-1047 | 308-349 |
| CD3ζ signaling domain | 1048-1383 | 350-461 |

TABLE I

Annotation of axicabtagene ciloleucel CD19 CAR sequences

| Feature | Nucleotide Sequence Position | Amino Acid Sequence Position |
|---|---|---|
| CSF2RA signal peptide | 1-66 | 1-22 |
| FMC63 scFv ($V_L$-Whitlow linker-$V_H$) | 67-801 | 23-267 |
| CD28 hinge domain | 802-927 | 268-309 |
| CD28 transmembrane domain | 928-1008 | 310-336 |
| CD28 costimulatory domain | 1009-1131 | 337-377 |
| CD3ζ signaling domain | 1132-1467 | 378-489 |

In some embodiments, the polycistronic vector comprises an expression cassette that contains a nucleotide sequence encoding CD19 CAR as set forth in SEQ ID NO: 1131, 1133, or 1135, or at least 80% identical (e.g., at least 80%, at least 85%, at least 90%, at least 95%, at least 96%, at least 97%, at least 98%, at least 99%, or 100% identical) to the nucleotide sequence set forth in SEQ ID NO: 1131, 1133, or 1135. The encoded CD19 CAR has a corresponding amino acid sequence set forth in SEQ ID NO: 1132, 1134, or 1136, respectively, is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1132, 1134, or 1136, respectively.

CD20 CAR In some embodiments, the CAR is a CD20 CAR ("CD20-CAR"), and in these embodiments, the polycistronic vector comprises an expression cassette that contains a nucleotide sequence encoding a CD20 CAR. CD20 is an antigen found on the surface of B cells as early at the pro-B phase and progressively at increasing levels until B cell maturity, as well as on the cells of most B-cell neoplasms. CD20 positive cells are also sometimes found in cases of Hodgkins disease, myeloma, and thymoma. In some embodiments, the CD20 CAR may comprise a signal peptide, an extracellular binding domain that specifically binds CD20, a hinge domain, a transmembrane domain, an intracellular costimulatory domain, and/or an intracellular signaling domain in tandem.

In some embodiments, the signal peptide of the CD20 CAR comprises a CD8α signal peptide. In some embodiments, the CD8α signal peptide comprises or consists of an amino acid sequence set forth in SEQ ID NO:1106 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1106. In some embodiments, the signal peptide comprises an IgK signal peptide. In some embodiments, the IgK signal peptide comprises or consists of an amino acid sequence set forth in SEQ ID NO:1107 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1107. In some embodiments, the signal peptide comprises a GMCSFR-α or CSF2RA signal peptide. In some embodiments, the GMCSFR-α or CSF2RA signal peptide comprises or consists of an amino acid sequence set forth in SEQ ID NO: 1108 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1108.

In some embodiments, the extracellular binding domain of the CD20 CAR is specific to CD20, for example, human CD20. The extracellular binding domain of the CD20 CAR can be codon-optimized for expression in a host cell or to have variant sequences to increase functions of the extracellular binding domain. In some embodiments, the extracellular binding domain comprises an immunogenically active portion of an immunoglobulin molecule, for example, an scFv.

In some embodiments, the extracellular binding domain of the CD20 CAR is derived from an antibody specific to CD20, including, for example, Leu16, IFS, 1.5.3, rituximab, obinutuzumab, ibritumomab, ofatumumab, tositumomab, odronextamab, veltuzumab, ublituximab, and ocrelizumab. In any of these embodiments, the extracellular binding domain of the CD20 CAR can comprise or consist of the $V_H$, the $V_L$, and/or one or more CDRs of any of the antibodies.

In some embodiments, the extracellular binding domain of the CD20 CAR comprises an scFv derived from the Leu16 monoclonal antibody, which comprises the heavy chain variable region ($V_H$) and the light chain variable region ($V_L$) of Leu16 connected by a linker. See Wu et al., Protein Engineering. 14(12):1025-1033 (2001). In some embodiments, the linker is a 3xG$_4$S linker (SEQ ID NO: 1130). In other embodiments, the linker is a Whitlow linker as described herein. In some embodiments, the amino acid sequences of different portions of the entire Leu16-derived scFv (also referred to as Leu16 scFv) and its different portions are provided in Table J below. In some embodiments, the CD20-specific scFv comprises or consists of an amino acid sequence set forth in SEQ ID NO: 1137, 1138, or 1142, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1137, 1138, or 1142. In some embodiments, the CD20-specific scFv may comprise one or more CDRs having amino acid sequences set forth in SEQ ID NOs: 1139-1141, 1143 and 1144. In some embodiments, the CD20-specific scFv may comprise a light chain with one or more CDRs having amino acid sequences set forth in SEQ ID NOs: 1139-1141. In some embodiments, the CD20-specific scFv may comprise a heavy chain with one or more CDRs having amino acid sequences set forth in SEQ ID NOs: 1143-1144. In any of these embodiments, the CD20-specific scFv may comprise one or more CDRs comprising one or more amino acid substitutions, or comprising a sequence that is at least 80% identical (e.g., at least 80%, at least 85%, at least 90%, at least 95%, at least 96%, at least 97%, at least 98%, at least 99%, or 100% identical), to any of the sequences identified. In some embodiments, the extracellular binding domain of the CD20 CAR comprises or consists of the one or more CDRs as described herein.

TABLE J

Exemplary sequences of anti-CD20 scFv and components

| SEQ ID NO: | Amino Acid Sequence | Description |
|---|---|---|
| 1137 | DIVLTQSPAILSASPGEKVT MT-CRASSSVNYMDWYQKKP GSSPKP-WIYATSNLAS-GV PARFSGSGSGTSYSLTISRV EAEDAATYYCQQWS-FNPPT FGGGTKLEIKGSTSGSGKPG SGEGSTKGEVQLQQSGAELV KP-GASVKMSCKASGYTFTS YN-MHWVKQTPGQGLEWIGA I-YPGNGDTSYNQKFKGKAT LTADKS | Anti-CD20 Leu16 scFv entire sequence, with Whitlow linker |
| 1138 | SSTAYMQLSSLTSED-SADY YCARSNYYGSSYWFFDVW-G AGTTVTVSSDIVLTQSPAIL SASPGEKVTMT-CRASSSVN YMDWYQKKPGSSPKP-WIYA TSNLAS-GVPARFSGSGSGT SYSLTISRVEAEDAATYYCQ QWS-FNPPTFGGGTKLEIK | Anti-CD20 Leu16 scFv light chain variable region |
| 1139 | RASSSVNYMD | Anti-CD20 Leu16 scFv light chain CDR1 |
| 1140 | ATSNLAS | Anti-CD20 Leu16 scFv light chain CDR2 |
| 1141 | QQWSFNPPT | Anti-CD20 Leu16 scFv light chain CDR3 |
| 1142 | EVQLQQSGAELVKPGASVKM SCK-ASGYTFTSYN-MHWVK QTPGQGLEWIGAIYPGNG-D TSYNQKFKGKATLTADKSSS TAYMQLSSLTSED-SADYYC ARSNYYGSSYWFFDVW-GAG TTVTVSS | Anti-CD20 Leu16 scFv heavy chain |
| 1143 | SYNMH | Anti-CD20 Leu16 scFv heavy chain CDR1 |
| 1144 | AIYPGNGDTSYNQKFKG | Anti-CD20 Leu16 scFv heavy chain CDR2 |

In some embodiments, the hinge domain of the CD20 CAR comprises a CD8α hinge domain, for example, a human CD8α hinge domain. In some embodiments, the CD8α hinge domain comprises or consists of an amino acid sequence set forth in SEQ ID NO: 1109 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1109. In some embodiments, the hinge domain comprises a CD28 hinge domain, for example, a human CD28 hinge domain. In some embodiments, the CD28 hinge domain comprises or consists of an amino acid sequence set forth in SEQ ID NO: 1110 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1110. In some embodiments, the hinge domain comprises an IgG4 hinge domain, for example, a human IgG4 hinge domain. In some embodiments, the IgG4 hinge domain comprises or consists of an amino acid sequence set forth in SEQ ID NO: 1111 or SEQ ID NO: 1112, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1111 or SEQ ID NO: 1112. In some embodiments, the hinge domain comprises a IgG4 hinge-Ch2-Ch3 domain, for example, a human IgG4 hinge-Ch2-Ch3 domain. In some embodiments, the IgG4 hinge-Ch2-Ch3 domain comprises or consists of an amino acid sequence set forth in SEQ ID NO:1113 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1113. In some embodiments, the transmembrane domain of the CD20 CAR comprises a CD8α transmembrane domain, for example, a human CD8α transmembrane domain. In some embodiments, the CD8α transmembrane domain comprises or consists of an amino acid sequence set forth in SEQ ID NO: 1114 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1114. In some embodiments, the transmembrane domain comprises a CD28 transmembrane domain, for example, a human CD28 transmembrane domain. In some embodiments, the CD28 transmembrane domain comprises or consists of an amino acid sequence set forth in SEQ ID NO: 1115 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1115.

In some embodiments, the intracellular costimulatory domain of the CD20 CAR comprises a 4-1 BB costimulatory domain, for example, a human 4-1 BB costimulatory domain. In some embodiments, the 4-1 BB costimulatory domain comprises or consists of an amino acid sequence set forth in SEQ ID NO: 1116 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1116. In some embodiments, the intracellular costimulatory domain comprises a CD28 costimulatory domain, for example, a human CD28 costimulatory domain. In some embodiments, the CD28 costimulatory domain comprises or consists of an amino acid sequence set forth in SEQ ID NO: 1117 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1117.

In some embodiments, the intracellular signaling domain of the CD20 CAR comprises a CD3 zeta (ζ) signaling domain, for example, a human CD3ζ signaling domain. In some embodiments, the CD3ζ signaling domain comprises or consists of an amino acid sequence set forth in SEQ ID NO: 1118 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1118.

In some embodiments, the polycistronic vector comprises an expression cassette that contains a nucleotide sequence encoding a CD20 CAR, including, for example, a CD20 CAR comprising the CD20-specific scFv having sequences set forth in SEQ ID NO: 1137, the CD8α hinge domain of SEQ ID NO: 1109, the CD8α transmembrane domain of SEQ ID NO: 1114, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD20 CAR, including, for example, a CD20 CAR comprising the CD20-specific scFv having sequences set forth in SEQ ID NO: 1137, the CD28 hinge domain of SEQ ID NO: 1110, the CD8α transmembrane domain of SEQ ID NO: 1114, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD20 CAR, including, for example, a CD20 CAR comprising the CD20-specific scFv having sequences set forth in SEQ ID NO: 1137, the IgG4 hinge domain of SEQ ID NO: 1111 or SEQ ID NO: 1112, the CD8α transmembrane domain of SEQ ID NO: 1114, the 4-1 BB costimulatory domain of SEQ ID NO: 1116, the CD3 signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD20 CAR, including, for example, a CD20 CAR comprising the CD20-specific scFv having sequences set forth in SEQ ID NO: 1137, the CD8α hinge domain of SEQ ID NO: 1109, the CD28 transmembrane domain of SEQ ID NO: 1115, the 4-1 BB costimulatory domain of SEQ ID NO: 1116, the CD3 signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD20 CAR, including, for example, a CD20

CAR comprising the CD20-specific scFv having sequences set forth in SEQ ID NO: 1137, the CD28 hinge domain of SEQ ID NO: 1110, the CD28 transmembrane domain of SEQ ID NO: 1115, the 4-1 BB costimulatory domain of SEQ ID NO: 1116, the CD3 signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD20 CAR, including, for example, a CD20 CAR comprising the CD20-specific scFv having sequences set forth in SEQ ID NO: 1137, the IgG4 hinge domain of SEQ ID NO: 1111 or SEQ ID NO: 1112, the CD28 transmembrane domain of SEQ ID NO: 1115, the 4-1 BB costimulatory domain of SEQ ID NO: 1116, the CD3 signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

CD22 CAR

In some embodiments, the CAR is a CD22 CAR ("CD22-CAR"), and in these embodiments, the polycistronic vector comprises an expression cassette that contains a nucleotide sequence encoding a CD22 CAR. CD22, which is a transmembrane protein found mostly on the surface of mature B cells that functions as an inhibitory receptor for B cell receptor (BCR) signaling. CD22 is expressed in 60-70% of B cell lymphomas and leukemias (e.g., B-chronic lymphocytic leukemia, hairy cell leukemia, acute lymphocytic leukemia (ALL), and Burkitt's lymphoma) and is not present on the cell surface in early stages of B cell development or on stem cells. In some embodiments, the CD22 CAR may comprise a signal peptide, an extracellular binding domain that specifically binds CD22, a hinge domain, a transmembrane domain, an intracellular costimulatory domain, and/or an intracellular signaling domain in tandem.

In some embodiments, the signal peptide of the CD22 CAR comprises a CD8α signal peptide. In some embodiments, the CD8α signal peptide comprises or consists of an amino acid sequence set forth in SEQ ID NO: 1106 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1106. In some embodiments, the signal peptide comprises an IgK signal peptide. In some embodiments, the IgK signal peptide comprises or consists of an amino acid sequence set forth in SEQ ID NO: 1107 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1107. In some embodiments, the signal peptide comprises a GMCSFR-α or CSF2RA signal peptide. In some embodiments, the GMCSFR-α or CSF2RA signal peptide comprises or consists of an amino acid sequence set forth in SEQ ID NO: 1108 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1108.

In some embodiments, the extracellular binding domain of the CD22 CAR is specific to CD22, for example, human CD22. The extracellular binding domain of the CD22 CAR can be codon-optimized for expression in a host cell or to have variant sequences to increase functions of the extracellular binding domain. In some embodiments, the extracellular binding domain comprises an immunogenically active portion of an immunoglobulin molecule, for example, an scFv.

In some embodiments, the extracellular binding domain of the CD22 CAR is derived from an antibody specific to CD22, including, for example, SM03, inotuzumab, epratuzumab, moxetumomab, and pinatuzumab. In any of these embodiments, the extracellular binding domain of the CD22 CAR can comprise or consist of the VH, the $V_L$, and/or one or more CDRs of any of the antibodies.

In some embodiments, the extracellular binding domain of the CD22 CAR comprises an scFv derived from the m971 monoclonal antibody (m971), which comprises the heavy chain variable region ($V_H$) and the light chain variable region ($V_L$) of m971 connected by a linker. In some embodiments, the linker is a 3xG$_4$S linker. In other embodiments, the Whitlow linker may be used instead. In some embodiments, the amino acid sequences of the entire m971-derived scFv (also referred to as m971 scFv) and its different portions are provided in Table K below. In some embodiments, the CD22-specific scFv comprises or consists of an amino acid sequence set forth in SEQ ID NO: 1145, 1146, or 1150, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1145, 1146, or 1150. In some embodiments, the CD22-specific scFv may comprise one or more CDRs having amino acid sequences set forth in SEQ ID NOs: 1147-1149 and 1151-1153. In some embodiments, the CD22-specific scFv may comprise a heavy chain with one or more CDRs having amino acid sequences set forth in SEQ ID NOs: 1147-1149. In some embodiments, the CD22-specific scFv may comprise a light chain with one or more CDRs having amino acid sequences set forth in SEQ ID NOs: 1151-1153. In any of these embodiments, the CD22-specific scFv may comprise one or more CDRs comprising one or more amino acid substitutions, or comprising a sequence that is at least 80% identical (e.g., at least 80%, at least 85%, at least 90%, at least 95%, at least 96%, at least 97%, at least 98%, at least 99%, or 100% identical), to any of the sequences identified. In some embodiments, the extracellular binding domain of the CD22 CAR comprises or consists of the one or more CDRs as described herein.

In some embodiments, the extracellular binding domain of the CD22 CAR comprises an scFv derived from m971-L7, which is an affinity matured variant of m971 with significantly improved CD22 binding affinity compared to the parental antibody m971 (improved from about 2 nM to less than 50 pM). In some embodiments, the scFv derived from m971-L7 comprises the $V_H$ and the $V_L$ of m971-L7 connected by a 3xG$_4$S linker (SEQ ID NO: 1130). In other embodiments, the Whitlow linker may be used instead. In some embodiments, the amino acid sequences of the entire m971-L7-derived scFv (also referred to as m971-L7 scFv) and its different portions are provided in Table K below.

In some embodiments, the CD22-specific scFv comprises or consists of an amino acid sequence set forth in SEQ ID NO: 1154, 1155, or 1159, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1154, 1155, or 1159.

In some embodiments, the CD22-specific scFv may comprise one or more CDRs having amino acid sequences set forth in SEQ ID NOs: 1156-1158 and 1160-1162. In some embodiments, the CD22-specific scFv may comprise a heavy chain with one or more CDRs having amino acid sequences set forth in SEQ ID NOs: 1156-1158. In some embodiments, the CD22-specific scFv may comprise a light chain with one or more CDRs having amino acid sequences set forth in SEQ ID NOs: 1160-1162. In any of these embodiments, the CD22-specific scFv may comprise one or more CDRs comprising one or more amino acid substitutions, or comprising a sequence that is at least 80% identical (e.g., at least 80%, at least 85%, at least 90%, at least 95%, at least 96%, at least 97%, at least 98%, at least 99%, or 100% identical), to any of the sequences identified. In some embodiments, the extracellular binding domain of the CD22 CAR comprises or consists of the one or more CDRs as described herein.

TABLE K

Exemplary sequences of anti-CD22 scFv and components

| SEQ ID NO: | Amino Acid Sequence | Description |
|---|---|---|
| 1145 | QVQLQQSGPGLVKP-SQTLS LTCAISGDSVSS-NSAAWNW IRQSPSR-GLEWLGRTYYRS KWYNDYAVSVKSRITINPDT SKNQFSLQLNSVTPED-TAV YYCAREVTGDLEDAFD-IWG QGTMVTVSSGGGGSGGGGS GGGGSDIQMTQSPSSLSASVG -DRVTITCRASQTI-WSYLN WYQQRPGKAPNLLIYAAS-S LQSGVPSRFSGRGSGTDFTL TISSLQAEDFA-TYYCQQSY SIPQTFGQGTKLEIK | Anti-CD22 m971 scFv entire sequence, with 3xG$_4$S linker (SEQ ID NO: 1130) |
| 1146 | QVQLQQSGPGLVKP-SQTLS LTCAISGDSVSS-NSAAWNW IRQSPSR-GLEWLGRTYYRS KWYNDYAVSVKSRITINPDT SKNQFSLQLNSVTPED-TAV YYCAREVTGDLEDAFD-IWG QGTMVTVSS | Anti-CD22 m971 scFv heavy chain variable region |
| 1147 | GDSVSSNSAA | Anti-CD22 m971 scFv heavy chain CDR1 |
| 1148 | TYYRSKWYN | Anti-CD22 m971 scFv heavy chain CDR2 |
| 1149 | AREVTGDLEDAFDI | Anti-CD22 m971 scFv heavy chain CDR3 |
| 1150 | DIQMTQSPSSLSASVG-DRV TITCRASQTI-WSYLNWYQQ RPGKAPNLLIYAAS-SLQSG VPSRFSGRGSGTDFTLTISS LQAEDFA-TYYCQQSYSIPQ TFGQGTKLEIK | Anti-CD22 m971 scFv light chain |
| 1151 | QTIWSY | Anti-CD22 m971 scFv light chain CDR1 |
| 1152 | AAS | Anti-CD22 m971 scFv light chain CDR2 |
| 1153 | QQSYSIPQT | Anti-CD22 m971 scFv light chain CDR3 |

TABLE K-continued

Exemplary sequences of anti-CD22 scFv and components

| SEQ ID NO: | Amino Acid Sequence | Description |
|---|---|---|
| 1154 | QVQLQQSGPGMVKP-SQTLS LTCAISGDSVSS-NSVAWNW IRQSPSR-GLEWLGRTYYRS T-WYNDYAVSMKSRITINPD TNKNQFSLQLNSVTPEDTAV YYCAREV-TGDLEDAFD-IW GQGTMVTVSSGGGGSGGGGS GGGGSDIQMIQSPSSLSASV G-DRVTITCRASQTI-WSYL NWYRQRPGEAPNLLIYAAS- SLQSGVPSRFSGRGSGTDFT LTISSLQAEDFA-TYYCQQS YSIPQTFGQGTKLEIK | Anti-CD22 m971-L7 scFv entire sequence, with 3xG$_4$S linker (SEQ ID NO: 1130) |
| 1155 | QVQLQQSGPGMVKP-SQTLS LTCAISGDSVSS-NSVAWNW IRQSPSR-GLEWLGRTYYRS T-WYNDYAVSMKSRITINPD TNKNQFSLQLNSVTPEDTAV YYCAREV-TGDLEDAFDIWG QGTMVTVSS | Anti-CD22 m971-L7 scFv heavy chain variable region |
| 1156 | GDSVSSNSVA | Anti-CD22 m971-L7 scFv heavy chain CDR1 |
| 1157 | TYYRSTWYN | Anti-CD22 m971-L7 scFv heavy chain CDR2 |
| 1158 | AREVTGDLEDAFDI | Anti-CD22 m971-L7 scFv heavy chain CDR3 |
| 1159 | DIQMIQSPSSLSASVG-DRV TITCRASQTI-WSYLNWYRQ RPGEAPNLLIYAAS-SLQSG VPSRFSGRGSGTDFTLTISS LQAEDFA-TYYCQQSYSIPQ TFGQGTKLEIK | Anti-CD22 m971-L7 scFv light chain variable region |
| 1160 | QTIWSY | Anti-CD22 m971-L7 scFv light chain CDR1 |
| 1161 | AAS | Anti-CD22 m971-L7 scFv light chain CDR2 |
| 1162 | QQSYSIPQT | Anti-CD22 m971-L7 scFv light chain CDR3 |

In some embodiments, the extracellular binding domain of the CD22 CAR comprises immunotoxins HA22 or BL22. Immunotoxins BL22 and HA22 are therapeutic agents that comprise an scFv specific for CD22 fused to a bacterial toxin, and thus can bind to the surface of the cancer cells that express CD22 and kill the cancer cells. BL22 comprises a dsFv of an anti-CD22 antibody, RFB4, fused to a 38-kDa truncated form of *Pseudomonas* exotoxin A (Bang et al., Clin. Cancer Res., 11:1545-50 (2005)). HA22 (CAT8015, moxetumomab pasudotox) is a mutated, higher affinity version of BL22 (Ho et al., J. Biol. Chem., 280(1): 607-17 (2005)). Suitable sequences of antigen binding domains of HA22 and BL22 specific to CD22 are disclosed in, for example, U.S. Pat. Nos. 7,541,034; 7,355,012; and 7,982,011, which are hereby incorporated by reference in their entirety.

In some embodiments, the hinge domain of the CD22 CAR comprises a CD8α hinge domain, for example, a human CD8α hinge domain. In some embodiments, the CD8α hinge domain comprises or consists of an amino acid sequence set forth in SEQ ID NO: 1109 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1109. In some embodiments, the hinge domain comprises a CD28 hinge domain, for example, a human CD28 hinge domain. In some embodiments, the CD28 hinge domain comprises or consists of an amino acid sequence set forth in SEQ ID NO: 1110 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1110. In some embodiments, the hinge domain comprises an IgG4 hinge domain, for example, a human IgG4 hinge domain. In some embodiments, the IgG4 hinge domain comprises or consists of an amino acid sequence set forth in SEQ ID NO: 1111 or SEQ ID NO: 1112, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1111 or SEQ ID NO: 1112. In some embodiments, the hinge domain comprises a IgG4 hinge-Ch2-Ch3 domain, for example, a human IgG4 hinge-Ch2-Ch3 domain. In some embodiments, the IgG4 hinge-Ch2-Ch3 domain comprises or consists of an amino acid sequence set forth in SEQ ID NO: 1113 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1113. In some embodiments, the transmembrane domain of the CD22 CAR comprises a CD8α transmembrane domain, for example, a human CD8α transmembrane domain. In some embodiments, the CD8α transmembrane domain comprises or consists of an amino acid sequence set forth in SEQ ID NO: 1114 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1114. In some embodiments, the transmembrane domain comprises a CD28 transmembrane domain, for example, a human CD28 transmembrane domain. In some embodiments, the CD28 transmembrane domain comprises or consists of an amino acid sequence set forth in SEQ ID NO:1115 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1115.

In some embodiments, the intracellular costimulatory domain of the CD22 CAR comprises a 4-1 BB costimulatory domain, for example, a human 4-1 BB costimulatory domain. In some embodiments, the 4-1 BB costimulatory domain comprises or consists of an amino acid sequence set forth in SEQ ID NO: 1116 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1116. In some embodiments, the intracellular costimulatory domain comprises a CD28 costimulatory domain, for example, a human CD28 costimulatory domain. In some embodiments, the CD28 costimulatory domain comprises or consists of an amino acid sequence set forth in SEQ ID NO: 1117 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1117.

In some embodiments, the intracellular signaling domain of the CD22 CAR comprises a CD3 zeta (ζ) signaling domain, for example, a human CD3ζ signaling domain. In some embodiments, the CD3ζ signaling domain comprises or consists of an amino acid sequence set forth in SEQ ID NO: 1118 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1118.

In some embodiments, the polycistronic vector comprises an expression cassette that contains a nucleotide sequence encoding a CD22 CAR, including, for example, a CD22 CAR comprising the CD22-specific scFv having sequences set forth in SEQ ID NO: 1145 or SEQ ID NO: 1154, the CD8α hinge domain of SEQ ID NO:9, the CD8α transmembrane domain of SEQ ID NO: 1114, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD22 CAR, including, for example, a CD22 CAR comprising the CD22-specific scFv having sequences set forth in SEQ ID NO: 1145 or SEQ ID NO: 1154, the CD28 hinge domain of SEQ ID NO: 1110, the CD8α transmembrane domain of SEQ ID NO: 1114, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD22 CAR, including, for example, a CD22 CAR comprising the CD22-specific scFv having sequences set forth in SEQ ID NO: 1145 or SEQ ID NO: 1154, the IgG4 hinge domain of SEQ ID NO: 1111 or SEQ ID NO: 1112, the CD8α transmembrane domain of SEQ ID NO: 1114, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD22 CAR, including, for example, a CD22 CAR comprising the CD22-specific scFv having sequences set forth in SEQ ID NO: 1145 or SEQ ID NO: 1154, the CD8α hinge domain of SEQ ID NO:9, the CD28 transmembrane domain of SEQ ID NO: 1115, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD22 CAR, including, for example, a CD22 CAR comprising the CD22-specific scFv having sequences set forth in SEQ ID NO: 1145 or SEQ ID NO: 1154, the CD28 hinge domain of SEQ ID NO: 1110, the CD28 transmembrane domain of SEQ ID NO: 1115, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

In some embodiments, the polycistronic vector comprises an expression cassette that contains a nucleotide sequence encoding a CD22 CAR, including, for example, a CD22 CAR comprising the CD22-specific scFv having sequences set forth in SEQ ID NO: 1145 or SEQ ID NO: 1154, the IgG4 hinge domain of SEQ ID NO: 1111 or SEQ ID NO: 1112, the CD28 transmembrane domain of SEQ ID NO: 1115, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof.

BCMA CAR

In some embodiments, the CAR is a BCMA CAR ("BCMA-CAR"), and in these embodiments, the polycistronic vector comprises an expression cassette that contains a nucleotide sequence encoding a BCMA CAR. BCMA is a tumor necrosis family receptor (TNFR) member expressed on cells of the B cell lineage, with the highest expression on terminally differentiated B cells or mature B lymphocytes. BCMA is involved in mediating the survival of plasma cells for maintaining long-term humoral immunity. The expression of BCMA has been recently linked to a number of cancers, such as multiple myeloma, Hodgkin's and non-Hodgkin's lymphoma, various leukemias, and glioblastoma. In some embodiments, the BCMA CAR may comprise a signal peptide, an extracellular binding domain that specifically binds BCMA, a hinge domain, a transmembrane domain, an intracellular costimulatory domain, and/or an intracellular signaling domain in tandem.

In some embodiments, the signal peptide of the BCMA CAR comprises a CD8α signal peptide. In some embodiments, the CD8α signal peptide comprises or consists of an amino acid sequence set forth in SEQ ID NO: 1106 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1106. In some embodiments, the signal peptide comprises an IgK signal peptide. In some embodiments, the IgK signal peptide comprises or consists of an amino acid sequence set forth in SEQ ID NO: 1107 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO:1107. In some embodiments, the signal peptide comprises a GMCSFR-α or CSF2RA signal peptide. In some embodiments, the GMCSFR-α or CSF2RA signal peptide comprises or consists of an amino acid sequence set forth in SEQ ID NO: 1108 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1108.

In some embodiments, the extracellular binding domain of the BCMA CAR is specific to BCMA, for example, human BCMA. The extracellular binding domain of the BCMA CAR can be codon-optimized for expression in a host cell or to have variant sequences to increase functions of the extracellular binding domain.

In some embodiments, the extracellular binding domain comprises an immunogenically active portion of an immunoglobulin molecule, for example, an scFv. In some embodiments, the extracellular binding domain of the BCMA CAR is derived from an antibody specific to BCMA, including, for example, belantamab, erlanatamab, teclistamab, LCAR-B38M, and ciltacabtagene. In any of these embodiments, the extracellular binding domain of the BCMA CAR can comprise or consist of the $V_H$, the $V_L$, and/or one or more CDRs of any of the antibodies.

In some embodiments, the extracellular binding domain of the BCMA CAR comprises an scFv derived from C11 D5.3, a murine monoclonal antibody as described in Carpenter et al., Clin. Cancer Res. 19(8):2048-2060 (2013). See also PCT Application Publication No. WO2010/104949. The C11 D5.3-derived scFv may comprise the heavy chain variable region ($V_H$) and the light chain variable region ($V_L$) of C11 D5.3 connected by the Whitlow linker, the amino acid sequences of which is provided in Table L below. In some embodiments, the BCMA-specific extracellular binding domain comprises or consists of an amino acid sequence set forth in SEQ ID NO: 1163, 1164, or 1168, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1163, 1164, or 1168. In some embodiments, the BCMA-specific extracellular binding domain may comprise one or more CDRs having amino acid sequences set forth in SEQ ID NOs: 1165-1167 and 1169-1171. In some embodiments, the BCMA-specific extracellular binding domain may comprise a light chain with one or more CDRs having amino acid sequences set forth in SEQ ID NOs: 1165-1167. In some embodiments, the BCMA-specific extracellular binding domain may comprise a heavy chain with one or more CDRs having amino acid sequences set forth in SEQ ID NOs: 1169-1171. In any of these embodiments, the BCMA-specific scFv may comprise one or more CDRs comprising one or more amino acid substitutions, or comprising a sequence that is at least 80% identical (e.g., at least 80%, at least 85%, at least 90%, at least 95%, at least 96%, at least 97%, at least 98%, at least 99%, or 100% identical), to any of the sequences identified. In some embodiments, the extracellular binding domain of the BCMA CAR comprises or consists of the one or more CDRs as described herein.

In some embodiments, the extracellular binding domain of the BCMA CAR comprises an scFv derived from another murine monoclonal antibody, C12A3.2, as described in Carpenter et al., Clin. Cancer Res. 19(8):2048-2060 (2013) and PCT Application Publication No. WO2010/104949, the amino acid sequence of which is also provided in Table L below. In some embodiments, the BCMA-specific extracellular binding domain comprises or consists of an amino acid sequence set forth in SEQ ID NO: 1172, 1173, or 1177, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1172, 1173, or 1177. In some embodiments, the BCMA-specific extracellular binding domain may comprise one or more CDRs having amino acid sequences set forth in SEQ ID NOs: 1174-1176 and 1178-1180. In some embodiments, the BCMA-specific extracellular binding domain may comprise a light chain with one or more CDRs having amino acid sequences set forth in SEQ ID NOs: 1174-1176. In some embodiments, the BCMA-specific extracellular binding domain may comprise a heavy chain with one or more CDRs having amino acid sequences set forth in SEQ ID NOs: 1178-1180. In any of these embodiments, the BCMA-specific scFv may comprise one or more CDRs comprising one or more amino acid substitutions, or comprising a sequence that is at least 80% identical (e.g., at least 80%, at least 85%, at least 90%, at least 95%, at least 96%, at least 97%, at least 98%, at least 99%, or 100% identical), to any of the sequences identified. In some embodiments, the extracellular binding domain of the BCMA CAR comprises or consists of the one or more CDRs as described herein.

In some embodiments, the extracellular binding domain of the BCMA CAR comprises a murine monoclonal antibody with high specificity to human BCMA, referred to as BB2121 in Friedman et al., Hum. Gene Ther. 29(5):585-601 (2018)). See also, PCT Application Publication No. WO2012163805.

In some embodiments, the extracellular binding domain of the BCMA CAR comprises single variable fragments of two heavy chains (VHH) that can bind to two epitopes of BCMA as described in Zhao et al., J. Hematol. Oncol. 11(1):141 (2018), also referred to as LCAR-B38M. See also, PCT Application Publication No. WO2018/028647.

In some embodiments, the extracellular binding domain of the BCMA CAR comprises a fully human heavy-chain variable domain (FHVH) as described in Lam et al., Nat. Com-mun. 11(1):283 (2020), also referred to as FHVH33. See also, PCT Application Publication No. WO2019/006072. The amino acid sequences of FHVH33 and its CDRs are provided in Table L below. In some embodiments, the BCMA-specific extracellular binding domain comprises or consists of an amino acid sequence set forth in SEQ ID NO: 1181 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1181. In some embodiments, the BCMA-specific extracellular binding domain may comprise one or more CDRs having amino acid sequences set forth in SEQ ID NOs: 1182-1184. In any of these embodiments, the BCMA-specific extracellular binding domain may comprise one or more CDRs comprising one or more amino acid substitutions, or comprising a sequence that is at least 80% identical (e.g., at least 80%, at least 85%, at least 90%, at least 95%, at least 96%, at least 97%, at least 98%, at least 99%, or 100% identical), to any of the sequences identified. In some embodiments, the extracellular binding domain of the BCMA CAR comprises or consists of the one or more CDRs as described herein.

In some embodiments, the extracellular binding domain of the BCMA CAR comprises an scFv derived from CT103A (or CAR0085) as described in U.S. Pat. No. 11,026,975 B2, the amino acid sequence of which is provided in Table L below. In some embodiments, the BCMA-specific extracellular binding domain comprises or consists of an amino acid sequence set forth in SEQ ID NO: 1218, 1219, or 1223, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1218, 1219, or 1223. In some embodiments, the BCMA-specific extracellular binding domain may comprise one or more CDRs having amino acid sequences set forth in SEQ ID NOs: 1220-1222 and 1224-1226. In some embodiments, the BCMA-specific extracellular binding domain may comprise a light chain with one or more CDRs having amino acid sequences set forth in SEQ ID NOs: 1220-1222. In some embodiments, the BCMA-specific extracellular binding domain may comprise a heavy chain with one or more CDRs having amino acid sequences set forth in SEQ ID NOs: 1224-1226. In any of these embodiments, the BCMA-specific scFv may comprise one or more CDRs comprising one or more amino acid substitutions, or comprising a sequence that is at least 80% identical (e.g., at least 80%, at least 85%, at least 90%, at least 95%, at least 96%, at least 97%, at least 98%, at least 99%, or 100% identical), to any of the sequences identified. In some embodiments, the extracellular binding domain of the BCMA CAR comprises or consists of the one or more CDRs as described herein.

Additionally, CARs and binders directed to BCMA have been described in U.S. Application Publication Nos. 2020/0246381 A1 and 2020/0339699 A1, the entire contents of each of which are incorporated by reference herein.

TABLE L

Exemplary sequences of anti-BCMA binder and components

| SEQ ID NO: | Amino Acid Sequence | Description |
|---|---|---|
| 1163 | DIVLTQSPASLAMSLGKRAT IS-CRASESVSVIGAHLIHW YQQKPGQPPKLLIYLASN-L ETGVPARFSGSGSGTDFT-L TIDPVEEDDVAIYSCLQSRI FPRT-FGGGTKLEIKGSTSG SGKPGSGEGSTKGQIQLVQS GPELKKPGETVKISCKASGY TFTDYSINWVKRAPGKGLKW MGWIN-TETREPAYAYDFRG RFAFSLETSASTAYLQINNL KYEDTATYFCAL-DYSYAMD YWGQGTSVTVSS | Anti-BCMA C11D5.3 scFv entire sequence, with Whitlow linker |
| 1164 | DIVLTQSPASLAMSLGKRAT IS-CRASESVSVIGAHLIHW YQQKPGQPPKLLIYLASN-L ETGVPARFSGSGSGTDFT-L TIDPVEEDDVAIYSCLQSRI FPRT-FGGGTKLEIK | Anti-BCMAC11D5.3 scFv light chain variable region |
| 1165 | RASESVSVIGAHLIH | Anti-BCMAC11D5.3 scFv light chain CDR1 |
| 1166 | LASNLET | Anti-BCMAC11D5.3 scFv light chain CDR2 |
| 1167 | LQSRIFPRT | Anti-BCMAC11D5.3 scFv light chain CDR3 |
| 1168 | QIQLVQSGPELKKPGETVKI SCK-ASGYTFTDYSINWVKR APGKGLK-WMGWIN-TETRE PAYAYDFRGRFAFSLETSAS TAYLQINNLKYEDTATYFCA L-DYSYAMDYWGQGTSVTVS S | Anti-BCMAC11D5.3 scFv heavy chain variable region |

TABLE L-continued

Exemplary sequences of anti-BCMA binder and components

| SEQ ID NO: | Amino Acid Sequence | Description |
|---|---|---|
| 1169 | DYSIN | Anti-BCMAC11D5.3 scFv heavy chain CDR1 |
| 1170 | WINTETREPAYAYDFRG | Anti-BCMAC11D5.3 scFv heavy chain CDR2 |
| 1171 | DYSYAMDY | Anti-BCMAC11D5.3 scFv heavy chain CDR3 |
| 1172 | DIVLTQSPPSLAMSLGKRAT IS-CRASESVTILGSHLI-Y WYQQKPGQPPTLLIQ-LASN VQTGVPARFSGSGSRTDFTL TIDPVEEDDVAVYYCLQSRT IPRT-FGGGTKLEIKGSTSG SGKPGSGEGSTKGQIQLVQS GPELKKPGETVKISCKASGY TFRHYSMNWVKQAPGKGLKW MGRINTESGVPIYADD-FKG RFAFSVETSASTAYL-VINN LKDEDTASYFCSNDYLYSLD -FWGQGTALTVSS | Anti-BCMA C12A3.2 scFv entire sequence, with Whitlow linker |
| 1173 | DIVLTQSPPSLAMSLGKRAT IS-CRASESVTILGSHLI-YWYQ QKPGQPPTLLIQ-LASNVQT GVPARFSGSGSRTDFTLTID PVEEDDVAVYYCLQSRTIPR T-FGGGTKLEIK | Anti-BCMA C12A3.2 scFv light chain variable region |
| 1174 | RASESVTILGSHLIY | Anti-BCMA C12A3.2 scFv light chain CDR1 |
| 1175 | LASNVQT | Anti-BCMA C12A3.2 scFv light chain CDR2 |
| 1176 | LQSRTIPRT | Anti-BCMA C12A3.2 scFv light chain CDR3 |
| 1177 | QIQLVQSGPELKKPGETVKI SCK-ASGYTFRHYSMNWVKQ APGKGLK-WMGRINTESGVP IYADDFKGRFAFSVETSAST AYL-VINNLKDEDTASYFCS NDYLYSLD-FWGQGTALTVS S | Anti-BCMA C12A3.2 scFv heavy chain variable region |
| 1178 | HYSMN | Anti-BCMA C12A3.2 scFv heavy chain CDR1 |
| 1179 | RINTESGVPIYADDFKG | Anti-BCMA C12A3.2 scFv heavy chain CDR2 |
| 1180 | DYLYSLDF | Anti-BCMA C12A3.2 scFv heavy chain CDR3 |
| 1181 | EVQLLESGGGLVQPGGSLRL S-CAASGFTSSYAMSWVR-QAPGKGLEWVSSISGSGDYI Y-YADSVKGRFTISRDISKN TLYLQMNSLRAEDTAVYYCA KEGTGANSSLADYRGQGTLV TVSS | Anti-BCMA FHVH33 entire sequence |
| 1182 | GFTFSSYA | Anti-BCMA FHVH33 CDR1 |
| 1183 | ISGSGDYI | Anti-BCMA FHVH33 CDR2 |
| 1184 | AKEGTGANSSLADY | Anti-BCMA FHVH33 CDR3 |
| 1218 | DIQMTQSPSSLSASVG-DRV TITCRASQSIS-SYLNWYQQ KPGKAPKLLIYAAS-SLQSG VPSRFSGSGSGTDFTLTISS LQPEDFA-TYYCQQKYDLLT FGGGTKVEIKGSTSGSGKPG SGEGSTKGQLQLQESGPGLV KPSETLSLTCTVSGGSIS-S SSYYWGWIRQPPGKGLEWIG -SISYSGSTYYNPSLKSRVT ISVDTSKNQFSLKLSSVTAA DTAVYYCARDRGDTILDVWG QGTMVTVSS | Anti-BCMA CT103A scFv entire sequence, with Whitlow linker |
| 1219 | DIQMTQSPSSLSASVG-DRV TITCRASQSIS-SYLNWYQQ KPGKAPKLLIYAAS-SLQSG VPSRFSGSGSGTDFTLTISS LQPEDFA-TYYCQQKYDLLT FGGGTKVEIK | Anti-BCMA CT103A scFv light chain variable region |
| 1220 | QSISSY | Anti-BCMA CT103A scFv light chain CDR1 |
| 1221 | AAS | Anti-BCMA CT103A scFv light chain CDR2 |
| 1222 | QQKYDLLT | Anti-BCMA CT103A scFv light chain CDR3 |
| 1223 | QLQLQESGPGLVKP-SETLS LTCTVSGGSIS-SSSYYWGW IRQPPGKGLEWIG-SISYSG STYYNPSLKSRVTISVDTSK NQFSLKLSSVTAADTAVYYC ARDRGDTILDVWGQGTMVTV SS | Anti-BCMA CT103A scFv heavy chain variable region |
| 1224 | GGSISSSSYY | Anti-BCMA CT103A scFv heavy chain CDR1 |
| 1225 | ISYSGST | Anti-BCMA CT103A scFv heavy chain CDR2 |
| 1226 | ARDRGDTILDV | Anti-BCMA CT103A scFv heavy chain CDR3 |

In some embodiments, the hinge domain of the BCMA CAR comprises a CD8α hinge domain, for example, a human CD8α hinge domain. In some embodiments, the CD8α hinge domain comprises or consists of an amino acid sequence set forth in SEQ ID NO: 1109 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1109. In some embodiments, the hinge domain comprises a CD28 hinge domain, for example, a human CD28 hinge domain. In some embodiments, the CD28 hinge domain comprises or consists of an amino acid sequence set forth in SEQ ID NO:

1110 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1110. In some embodiments, the hinge domain comprises an IgG4 hinge domain, for example, a human IgG4 hinge domain. In some embodiments, the IgG4 hinge domain comprises or consists of an amino acid sequence set forth in SEQ ID NO: 1111 or SEQ ID NO: 1112, or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1111 or SEQ ID NO: 1112. In some embodiments, the hinge domain comprises a IgG4 hinge-Ch2-Ch3 domain, for example, a human IgG4 hinge-Ch2-Ch3 domain. In some embodiments, the IgG4 hinge-Ch2-Ch3 domain comprises or consists of an amino acid sequence set forth in SEQ ID NO: 1113 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1113.

In some embodiments, the transmembrane domain of the BCMA CAR comprises a CD8α transmembrane domain, for example, a human CD8α transmembrane domain. In some embodiments, the CD8α transmembrane domain comprises or consists of an amino acid sequence set forth in SEQ ID NO: 1114 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1114. In some embodiments, the transmembrane domain comprises a CD28 transmembrane domain, for example, a human CD28 transmembrane domain. In some embodiments, the CD28 transmembrane domain comprises or consists of an amino acid sequence set forth in SEQ ID NO: 1115 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1115.

In some embodiments, the intracellular costimulatory domain of the BCMA CAR comprises a 4-1 BB costimulatory domain, for example, a human 4-1 BB costimulatory domain. In some embodiments, the 4-1 BB costimulatory domain comprises or consists of an amino acid sequence set forth in SEQ ID NO: 1116 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1116. In some embodiments, the intracellular costimulatory domain comprises a CD28 costimulatory domain, for example, a human CD28 costimulatory domain. In some embodiments, the CD28 costimulatory domain comprises or consists of an amino acid sequence set forth in SEQ ID NO: 1117 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1117.

In some embodiments, the intracellular signaling domain of the BCMA CAR comprises a CD3 zeta (ζ) signaling domain, for example, a human CD3 signaling domain. In some embodiments, the CD3 signaling domain comprises or consists of an amino acid sequence set forth in SEQ ID NO: 1118 or an amino acid sequence that is at least 80% identical (e.g., at least 80%, at least 85%, at least 90%, at least 95%, at least 96%, at least 97%, at least 98%, at least 99%, or 100% identical) to the amino acid sequence set forth in SEQ ID NO: 1118.

In some embodiments, the polycistronic vector comprises an expression cassette that contains a nucleotide sequence encoding a BCMA CAR, including, for example, a BCMA CAR comprising any of the BCMA-specific extracellular binding domains as described, the CD8α hinge domain of SEQ ID NO: 1109, the CD8α transmembrane domain of SEQ ID NO: 1114, the 4-1 BB costimulatory domain of SEQ ID NO: 1116, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof. In any of these embodiments, the BCMA CAR may additionally comprise a signal peptide (e.g., a CD8α signal peptide) as described.

In some embodiments, the polycistronic vector comprises an expression cassette that contains a nucleotide sequence encoding a BCMA CAR, including, for example, a BCMA CAR comprising any of the BCMA-specific extracellular binding domains as described, the CD8α hinge domain of SEQ ID NO: 1109, the CD8α transmembrane domain of SEQ ID NO: 1114, the CD28 costimulatory domain of SEQ ID NO: 1117, the CD3ζ signaling domain of SEQ ID NO: 1118, and/or variants (i.e., having a sequence that is at least 80% identical, for example, at least 80%, at least 85%, at least 90%, at least 95%, at least 96%, at least 97%, at least 98%, or at least 99 identical to the disclosed sequence) thereof. In any of these embodiments, the BCMA CAR may additionally comprise a signal peptide as described.

In some embodiments, the polycistronic vector comprises an expression cassette that contains a nucleotide sequence encoding a BCMA CAR as set forth in SEQ ID NO: 1227 or is at least 80% identical (e.g., at least 80%, at least 85%, at least 90%, at least 95%, at least 96%, at least 97%, at least 98%, at least 99%, or 100% identical) to the nucleotide sequence set forth in SEQ ID NO: 1227 (see Table M). The encoded BCMA CAR has a corresponding amino acid sequence set forth in SEQ ID NO: 1228 or is at least 80% identical (e.g., at least 80%, at least 85%, at least 90%, at least 95%, at least 96%, at least 97%, at least 98%, at least 99%, or 100% identical) to the amino acid sequence set forth in of SEQ ID NO: 1228, with the following components: CD8α signal peptide, CT103A scFv ($V_L$-Whitlow linker-VH), CD8α hinge domain, CD8α transmembrane domain, 4-1 BB costimulatory domain, and CD3 signaling domain.

In some embodiments, the polycistronic vector comprises an expression cassette that contains a nucleotide sequence encoding a commercially available embodiment of BCMA CAR, including, for example, idecabtagene vicleucel (ide-cel, also called bb2121). In some embodiments, the polycistronic vector comprises an expression cassette that contains a nucleotide sequence encoding idecabtagene vicleucel or portions thereof. Idecabtagene vicleucel comprises a BCMA CAR with the following components: the BB2121 binder, CD8α hinge domain, CD8α transmembrane domain, 4-1 BB costimulatory domain, and CD3 signaling domain.

TABLE M

Exemplary sequences of BCMA CARs

| SEQ ID NO: | Sequence | Description |
|---|---|---|
| 1227 | atggccttaccagtgaccgc cttgctcctgccgctggcct t-gctgctccac-gccgcca ggccggacatccagatgacc cagtctccatcctccctgtc tgcatctgtaggagacagag tcaccatcac-ttgccgggc aagtcagagcatt-agcagc tatttaaattggtatcagca gaaaccagggaaagcccta agctcctgatctatgctgca tccagttt-gcaaagtgggg tcccatcaaggttcag-tgg cagtggatctgggacagatt tcactctcaccatcagcagt ctgcaacctgaagattttgc aacttactactgtcag-caa aaatacgacctcctcac-tt ttggcggagggaccaaggtt gagatcaaaggcagcaccag cggctccggcaagcctggct ctggcgagggcag-cacaaa gggacagctgcagctgcag- gagtcgggcccaggactggt gaagccttcggagaccctgt ccctcacctgcactgtctct ggtggctccatcagcag-ta gtagttactactgggctg- gatccgccagccccaggga aggggctggagtggattggg agtatctcctatagtgggag cacctacta-caacccgtcc ctcaagagtcgagtcac-ca tatccgtagacacgtccaag aaccagttctccctgaagct gagttctgtgaccgccgcag acacggcggtg-tactactg cgccagagatcgtggagaca c-catactagacgtatgggg tcagggtacaatggtcaccg tcagctcattcgtgccgtg ttcctgcccgccaaacctac -caccaccctgccctaga c-ctcccaccccagccccaa caatcgccagccagcctctg tctctgcgggcccgaagcctg tagacctgctgccggcg-ga gccgtgcacaccagaggcct g-gacttcgcctgcgacatc tacatctgggcccctctggc cggcac-ctgtggcgtgctg ctgctgagcctggtgatcac cctg-tactgcaaccaccg- gaacaaacggggcagaaaga aactcctgtatatattcaaa caaccatttatgagaccagt acaaactactcaagag-gaa gatggctgtagctgccgat- ttccagaagaagaagaagga ggatgtgaactgagagtgaa gttcagcagatccgccgacg cccctgcctaccag-caggg acagaaccagctgtacaac- gagctgaacctgggcagacg ggaagagtacgacgtgctgg acaagcggagaggccgggac cccgagatgggcg-gaaagc ccagacggaagaacccccag -gaaggcctgtataacgaac tgcagaaagacaagatggcc gaggcctacagcgagatcgg -catgaagggcgagcggagg cgcggcaagggccac-gatg gcctgtaccagggcctgagc | Exemplary BCMA CAR nucleotide sequence |
| | accgccaccaaggacaccta cgacgccctg-cacatgcag gccctgccccccaga | |
| 1228 | MAL-PVTALLLPLALLLHAA RPDIQMTQSPSSLSASVGDR VTITCRASQSIS-SYLNWYQ QKPGKAPKLLIYAAS-SLQS GVPSRFSGSGSGTDFT-LTI SSLQPEDFATYYCQQKYDLL TFGGGTKVEIKGSTSGSGKP GSGEGSTKGQLQLQESGPGL VKPSETLSLTCTVSGGSIS- SSSYYWGWIRQPPGKGLEWI G-SISYSGSTYYNPSLKSRV TISVDTSKNQFSLKLSSVTA ADTAVYYCARDRGDTIL-DV WGQGTMVTVSS-FVPVFLPA KPTTTPAPRPPTPAP-TIAS QPLSLRPEACRPAAGGAVHT RGLDFACDIYIWAPLAGTCG VLLLSLVITLYC-NHRNKRG RKKLLY-IFKQPFMRPVQTT QEEDGCSCRFPEEEEGGCEL RVKFSRSADAPA-YQQGQNQ LYNELNLGR-REEYDVLDKR RGRDPEMGGKPRR-KNPQEG LYNELQKDKMAEAYSEIGMK GERRRGKGHDGLYQGLSTAT -KDTYDALHMQALPPR | Exemplary BCMA CAR amino acid sequence |

In some embodiments, the antibody portion of the recombinant receptor, e.g., CAR, further includes spacer between the transmembrane domain and extracellular antigen binding domain. In some embodiments, the spacer includes at least a portion of an immunoglobulin constant region, such as a hinge region, e.g., an IgG4 hinge region, and/or a CH1/CL and/or Fc region. In some embodiments, the constant region or portion is of a human IgG, such as IgG4 or IgGl. In some aspects, the portion of the constant region serves as a spacer region between the antigen-recognition component, e.g., scFv, and transmembrane domain. The spacer can be of a length that provides for increased responsiveness of the cell following antigen binding, as compared to in the absence of the spacer. Exemplary spacers include, but are not limited to, those described in Hudecek et al. (2013) Clin. Cancer Res., 19:3153, WO2014031687, U.S. Pat. No. 8,822,647 or published app. No. US 2014/0271635. In some embodiments, the constant region or portion is of a human IgG, such as IgG4 or IgGl.

In some embodiments, the antigen receptor comprises an intracellular domain linked directly or indirectly to the extracellular domain. In some embodiments, the chimeric antigen receptor includes a transmembrane domain linking the extracellular domain and the intracellular signaling domain. In some embodiments, the intracellular signaling domain comprises an ITAM. For example, in some aspects, the antigen recognition domain (e.g. extracellular domain) generally is linked to one or more intracellular signaling components, such as signaling components that mimic activation through an antigen receptor complex, such as a TCR complex, in the case of a CAR, and/or signal via another cell surface receptor. In some embodiments, the chimeric receptor comprises a transmembrane domain linked or fused between the extracellular domain (e.g. scFv) and intracellular signaling domain. Thus, in some embodiments, the antigen-binding component (e.g., antibody) is linked to one or more transmembrane and intracellular signaling domains.

In one embodiment, a transmembrane domain that naturally is associated with one of the domains in the receptor, e.g., CAR, is used. In some instances, the transmembrane domain is selected or modified by amino acid substitution to avoid binding of such domains to the transmembrane domains of the same or different surface membrane proteins to minimize interactions with other members of the receptor complex.

The transmembrane domain in some embodiments is derived either from a natural or from a synthetic source. Where the source is natural, the domain in some aspects is derived from any membrane-bound or transmembrane protein. Transmembrane regions include those derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD 134, CD 137, CD 154. Alternatively, the transmembrane domain in some embodiments is synthetic. In some aspects, the synthetic transmembrane domain comprises predominantly hydrophobic residues such as leucine and valine. In some aspects, a triplet of phenylalanine, tryptophan and valine will be found at each end of a synthetic transmembrane domain. In some embodiments, the linkage is by linkers, spacers, and/or transmembrane domain(s). In some aspects, the transmembrane domain contains a transmembrane portion of CD28.

In some embodiments, the extracellular domain and transmembrane domain can be linked directly or indirectly. In some embodiments, the extracellular domain and transmembrane are linked by a spacer, such as any described herein. In some embodiments, the receptor contains extracellular portion of the molecule from which the transmembrane domain is derived, such as a CD28 extracellular portion.

Among the intracellular signaling domains are those that mimic or approximate a signal through a natural antigen receptor, a signal through such a receptor in combination with a costimulatory receptor, and/or a signal through a costimulatory receptor alone. In some embodiments, a short oligo- or polypeptide linker, for example, a linker of between 2 and 10 amino acids in length, such as one containing glycines and serines, e.g., glycine-serine doublet, is present and forms a linkage between the transmembrane domain and the cytoplasmic signaling domain of the CAR.

T cell activation is in some aspects described as being mediated by two classes of cytoplasmic signaling sequences: those that initiate antigen-dependent primary activation through the TCR (primary cytoplasmic signaling sequences), and those that act in an antigen-independent manner to provide a secondary or co-stimulatory signal (secondary cytoplasmic signaling sequences). In some aspects, the CAR includes one or both of such signaling components.

The receptor, e.g., the CAR, generally includes at least one intracellular signaling component or components. In some aspects, the CAR includes a primary cytoplasmic signaling sequence that regulates primary activation of the TCR complex. Primary cytoplasmic signaling sequences that act in a stimulatory manner may contain signaling motifs which are known as immunoreceptor tyrosine-based activation motifs or ITAMs. Examples of ITAM containing primary cytoplasmic signaling sequences include those derived from CD3 zeta chain, FcR gamma, CD3 gamma, CD3 delta and CD3 epsilon. In some embodiments, cytoplasmic signaling molecule(s) in the CAR contain(s) a cytoplasmic signaling domain, portion thereof, or sequence derived from CD3 zeta.

In some embodiments, the receptor includes an intracellular component of a TCR complex, such as a TCR CD3 chain that mediates T-cell activation and cytotoxicity, e.g., CD3 zeta chain. Thus, in some aspects, the antigen-binding portion is linked to one or more cell signaling modules. In some embodiments, cell signaling modules include CD3 transmembrane domain, CD3 intracellular signaling domains, and/or other CD transmembrane domains. In some embodiments, the intracellular component is or includes a CD3-zeta intracellular signaling domain. In some embodiments, the intracellular component is or includes a signaling domain from Fc receptor gamma chain. In some embodiments, the receptor, e.g., CAR, includes the intracellular signaling domain and further includes a portion, such as a transmembrane domain and/or hinge portion, of one or more additional molecules such as CD8, CD4, CD25, or CD 16. For example, in some aspects, the CAR or other chimeric receptor is a chimeric molecule of CD3-zeta (CD3-z) or Fc receptor g and a portion of one of CD8, CD4, CD25 or CD16.

In some embodiments, upon ligation of the CAR or other chimeric receptor, the cytoplasmic domain or intracellular signaling domain of the receptor activates at least one of the normal effector functions or responses of the immune cell, e.g., T cell engineered to express the CAR. For example, in some contexts, the CAR induces a function of a T cell such as cytolytic activity or T-helper activity, such as secretion of cytokines or other factors. In some embodiments, a truncated portion of an intracellular signaling domain of an antigen receptor component or costimulatory molecule is used in place of an intact immunostimulatory chain, for example, if it transduces the effector function signal. In some embodiments, the intracellular signaling domain or domains include the cytoplasmic sequences of the T cell receptor (TCR), and in some aspects also those of co-receptors that in the natural context act in concert with such receptors to initiate signal transduction following antigen receptor engagement.

In the context of a natural TCR, full activation generally requires not only signaling through the TCR, but also a costimulatory signal. Thus, in some embodiments, to promote full activation, a component for generating secondary or co-stimulatory signal is also included in the CAR. In other embodiments, the CAR does not include a component for generating a costimulatory signal. In some aspects, an additional CAR is expressed in the same cell and provides the component for generating the secondary or costimulatory signal.

In some embodiments, the chimeric antigen receptor contains an intracellular domain of a T cell costimulatory molecule. In some embodiments, the CAR includes a signaling domain and/or transmembrane portion of a costimulatory receptor, such as CD28, 4-1BB, OX40, DAP10, and ICOS. In some aspects, the same CAR includes both the activating and costimulatory components. In some embodiments, the chimeric antigen receptor contains an intracellular domain derived from a T cell costimulatory molecule or a functional variant thereof, such as between the transmembrane domain and intracellular signaling domain. In some aspects, the T cell costimulatory molecule is CD28 or 41 BB.

In some embodiments, the activating domain is included within one CAR, whereas the costimulatory component is provided by another CAR recognizing another antigen. In some embodiments, the CARs include activating or stimulatory CARs, costimulatory CARs, both expressed on the same cell (see WO2014/055668). In some aspects, the cells include one or more stimulatory or activating CAR and/or a costimulatory CAR. In some embodiments, the cells further include inhibitory CARs (iCARs, see Fedorov et al., Sci. Transl. Medicine, 5(215) (December, 2013), such as a CAR recognizing an antigen other than the one associated with and/or specific for the disease or condition whereby an activating signal delivered through the disease-targeting CAR is diminished or inhibited by binding of the inhibitory CAR to its ligand, e.g., to reduce off-target effects.

In certain embodiments, the intracellular signaling domain comprises a CD28 transmembrane and signaling domain linked to a CD3 (e.g., CD3-zeta) intracellular domain. In some embodiments, the intracellular signaling domain comprises a chimeric CD28 and CD137 (4-1 BB, TNFRSF9) co-stimulatory domains, linked to a CD3 zeta intracellular domain.

In some embodiments, the CAR encompasses one or more, e.g., two or more, costimulatory domains and an activation domain, e.g., primary activation domain, in the cytoplasmic portion. Exemplary CARs include intracellular components of CD3-zeta, CD28, and 4-1 BB.

In some embodiments the intracellular signaling domain includes intracellular components of a 4-1 BB signaling domain and a CD3-zeta signaling domain. In some embodiments, the intracellular signaling domain includes intracellular components of a CD28 signaling domain and a CD3zeta signaling domain.

In some embodiments, the CAR comprises an extracellular antigen binding domain (e.g., antibody or antibody fragment, such as an scFv) that binds to an antigen (e.g. tumor antigen), a spacer (e.g. containing a hinge domain, such as any as described herein), a transmembrane domain (e.g. any as described herein), and an intracellular signaling domain (e.g. any intracellular signaling domain, such as a primary signaling domain or costimulatory signaling domain as described herein). In some embodiments, the intracellular signaling domain is or includes a primary cytoplasmic signaling domain. In some embodiments, the intracellular signaling domain additionally includes an intracellular signaling domain of a costimulatory molecule (e.g., a costimulatory domain). Examples of exemplary components of a CAR are described in Table 14. In provided aspects, the sequences of each component in a CAR can include any combination listed in Table 14.

TABLE 14

| Component | Sequence | SEQ ID NO: |
|---|---|---|
| Extracellular binding domain | | |
| Anti-CD19 scFv (FMC63) | DIQMTQTTSSLSASLGDRVT ISCRASQDISKYLNWYQQKP DGTVKLLIYHTSRLHSGVPS RFSGSGSGTDYSLTISNLEQ EDIATYFCQQGNTLPYTFGG GTKLEITGSTSGSGKPGSGE GSTKGEVKLQESGPGLVAPS QSLSVTCTVSGVSLPDYGVS WIRQPPRKGLEWLGVIWGSE TTYYNSALKSRLTIIKDNSK SQVFLKMNSLQTDDTAIYYC AKHYYYGGSYAMDYWGQGTS VTVSS | 1075 |

TABLE 14-continued

| Component | Sequence | SEQ ID NO: |
|---|---|---|
| Anti-CD19 scFv (FMC63) | DIQMTQTTSSLSASLGDRVT ISCRASQDISKYLNWYQQKP DGTVKLLIYHTSRLHSGVPS RFSGSGSGTDYSLTISNLEQ EDIATYFCQQGNTLPYTFGG GTKLEITGGGGSGGGGSGGG GSEVKLQESGPGLVAPSQSL SVTCTVSGVSLPDYGVSWIR QPPRKGLEWLGVIWGSETTY YNSALKSRLTIIKDNSKSQV FLKMNSLQTDDTAIYYCAKH YYYGGSYAMDYWGQGTSVTV SS | 1076 |
| Anti-BCMA sdAb (FHVH74) | QVQLVESGGGLVQPGGSLRL SCAASGFTFTNHAMSWVRQA PGKGLELVSSISGNGRTTYY ADSVKGRFTISRDISKNTLD LQMNSLRAEDTAVYYCAKDG GETLVDSRGQGTLVTVSS | 1077 |
| Anti-BCMA sdAb (FHVH32) | QVQLVESGGGLVQPGGSLRL SCAASGFTFSSHAMTWVRQA PGKGLEWVAAISGSGDFTHY ADSVKGRFTISRDNSKNTVS LQMNNLRAEDTAVYYCAKDE DGGSLLGYRGQGTLVTVSS | 1078 |
| Anti-BCMA sdAb (FHVH33) | EVQLLESGGGLVQPGGSLRL SCAASGFTFSSYAMSWVRQA PGKGLEWVSSISGSGDYIYY ADSVKGRFTISRDISKNTLY LQMNSLRAEDTAVYYCAKEG TGANSSLADYRGQGTLVTVS S | 1079 |
| Anti-BCMA sdAb (FHVH93) | EVQLLESGGGLIQPGGSLRL SCAASGFTFSSHAMTWVRQA PGKGLEWVSAISGSGDYTHY ADSVKGRFTISRDNSKNTVY LQMNSLRAEDSAVYYCAKDE DGGSLLGHRGQGTLVTVSS | 1080 |
| Spacer (e.g. hinge) | | |
| IgG4 Hinge | ESKYGPPCPPCP | 1081 |
| CD8 Hinge | TTTPAPRPPTPAPTIASQPL SLRPE | 1082 |
| CD28 | IEVMYPPPYLDNEKSNGTII HVKGKHLCPSPLFPGPSKP | 1083 |
| Transmembrane | | |
| CD8 | ACRPAAGGAVHTRGLDFACD IYIWAPLAGTCGVLLLSL-V ITLYC | 1084 |
| CD28 | FWVLVVVGGVLACYSLLVTV AFIIFWV | 1085 |
| CD28 | MFWVLVVVGGVLACYSLLVT VAFIIFWV | 1214 |
| Costimulatory domain | | |
| CD28 | RSKRSRLLHSDYMNMTPRRP GPTRKHYQPYAPPRDFAAYR S | 1086 |
| 4-1 BB | KRGRKKLLYIFKQPFMRPVQ TTQEEDGCSCRFPEEEEGGC EL | 1087 |

TABLE 14-continued

| Component | Sequence | SEQ ID NO: |
|---|---|---|
| Primary Signaling Domain | | |
| CD3zeta | RVKFSRSADAPAYQQGQNQL YNELNLGR-REEYDVLDKRR GRDPEMGGKPRRKNPQEGLY NEL-QKDKMAEAYSEIGMKG ERRRGKGHDGLYQGLSTATK DTYDALHMQALPPR | 1088 |
| CD3zeta (Q > K) | RVKFSRSADAPAYKQGQNQL YNELNLGR-REEYDVLDKRR GRDPEMGGKPRRKNPQEGLY NEL-QKDKMAEAYSEIGMKG ERRRGKGHDGLYQGLSTATK DTYDALHMQALPPR | 1089 |

In some embodiments, the antigen receptor further includes a marker and/or cells expressing the CAR or other antigen receptor further includes a surrogate marker, such as a cell surface marker, which may be used to confirm transduction or engineering of the cell to express the receptor. In some aspects, the marker includes all or part (e.g., truncated form) of CD34, a NGFR, or epidermal growth factor receptor, such as truncated version of such a cell surface receptor (e.g., tEGFR). In some embodiments, the nucleic acid encoding the marker is operably linked to a polynucleotide encoding for a linker sequence, such as a cleavable linker sequence, e.g., T2A. For example, a marker, and optionally a linker sequence, can be any as disclosed in published patent application No. WO2014031687. For example, the marker can be a truncated EGFR (tEGFR) that is, optionally, linked to a linker sequence, such as a T2A cleavable linker sequence.

In some embodiments, the marker is a molecule, e.g., cell surface protein, not naturally found on T cells or not naturally found on the surface of T cells, or a portion thereof. In some embodiments, the molecule is a non-self molecule, e.g., non-self protein, i.e., one that is not recognized as "self" by the immune system of the host into which the cells will be adoptively transferred.

In some embodiments, the marker serves no therapeutic function and/or produces no effect other than to be used as a marker for genetic engineering, e.g., for selecting cells successfully engineered. In other embodiments, the marker may be a therapeutic molecule or molecule otherwise exerting some desired effect, such as a ligand for a cell to be encountered in vivo, such as a costimulatory or immune checkpoint molecule to enhance and/or dampen responses of the cells upon adoptive transfer and encounter with ligand.

In some cases, CARs are referred to as first, second, and/or third generation CARs. In some aspects, a first generation CAR is one that solely provides a CD3-chain induced signal upon antigen binding; in some aspects, a second-generation CARs is one that provides such a signal and costimulatory signal, such as one including an intracellular signaling domain from a costimulatory receptor such as CD28 or CD 137; in some aspects, a third generation CAR is one that includes multiple costimulatory domains of different costimulatory receptors.

For example, in some embodiments, the CAR contains an antibody, e.g., an antibody fragment, a transmembrane domain that is or contains a transmembrane portion of CD28 or a functional variant thereof, and an intracellular signaling domain containing a signaling portion of CD28 or functional variant thereof and a signaling portion of CD3 zeta or functional variant thereof. In some embodiments, the CAR contains an antibody, e.g., antibody fragment, a transmembrane domain that is or contains a transmembrane portion of CD28 or a functional variant thereof, and an intracellular signaling domain containing a signaling portion of a 4-IBB or functional variant thereof and a signaling portion of CD3 zeta or functional variant thereof. In some such embodiments, the receptor further includes a spacer containing a portion of an Ig molecule, such as a human Ig molecule, such as an Ig hinge, e.g. an IgG4 hinge, such as a hinge-only spacer.

In some aspects, the spacer contains only a hinge region of an IgG, such as only a hinge of IgG4 or IgG. In other embodiments, the spacer is or contains an Ig hinge, e.g., an IgG4-derived hinge, optionally linked to a CH2 and/or CH3 domains. In some embodiments, the spacer is an Ig hinge, e.g., an IgG4 hinge, linked to CH2 and CH3 domains. In some embodiments, the spacer is an Ig hinge, e.g., an IgG4 hinge, linked to a CH3 domain only. In some embodiments, the spacer is or comprises a glycine-serine rich sequence or other flexible linker such as known flexible linkers.

For example, in some embodiments, the CAR includes an antibody such as an antibody fragment, including scFvs, a spacer, such as a spacer containing a portion of an immunoglobulin molecule, such as a hinge region and/or one or more constant regions of a heavy chain molecule, such as an Ig-hinge containing spacer, a transmembrane domain containing all or a portion of a CD28-derived transmembrane domain, a CD28-derived intracellular signaling domain, and a CD3 zeta signaling domain. In some embodiments, the CAR includes an antibody or fragment, such as scFv, a spacer such as any of the Ig-hinge containing spacers, a CD28-derived transmembrane domain, a 4-IBB-derived intracellular signaling domain, and a CD3 zeta-derived signaling domain.

The recombinant receptors, such as CARs, expressed by the cells administered to the subject generally recognize or specifically bind to a molecule that is expressed in, associated with, and/or specific for the disease or condition or cells thereof being treated. Upon specific binding to the molecule, e.g., antigen, the receptor generally delivers an immunostimulatory signal, such as an ITAM-transduced signal, into the cell, thereby promoting an immune response targeted to the disease or condition. For example, in some embodiments, the cells express a CAR that specifically binds to an antigen expressed by a cell or tissue of the disease or condition or associated with the disease or condition.

b. T Cell Receptors Antigen Receptors (TCRs)

In some embodiments, engineered cells, such as T cells, used in connection with the provided methods, uses, articles of manufacture or compositions are cells that express a T cell receptor (TCR) or antigen-binding portion thereof that recognizes an peptide epitope or T cell epitope of a target polypeptide, such as an antigen of a tumor, viral or autoimmune protein.

In some embodiments, a "T cell receptor" or "TCR" is a molecule that contains a variable a and b chains (also known as TCRalpha and TCRbeta, respectively) or a variable g and d chains (also known as TCRalpha and TCRbeta, respectively), or antigen-binding portions thereof, and which is capable of specifically binding to a peptide bound to an MHC molecule. In some embodiments, the TCR is in the ab form. Typically, TCRs that exist in ab and gd forms are generally structurally similar, but T cells expressing them may have distinct anatomical locations or functions. A TCR can be found on the surface of a cell or in soluble form. Generally, a TCR is found on the surface of T cells (or T lymphocytes) where it is generally responsible for recognizing antigens bound to major histocompatibility complex (MHC) molecules.

Unless otherwise stated, the term "TCR" should be understood to encompass full TCRs as well as antigen-binding portions or antigen-binding fragments thereof. In some embodiments, the TCR is an intact or full-length TCR, including TCRs in the ab form or gd form. In some embodiments, the TCR is an antigen-binding portion that is less than a full-length TCR but that binds to a specific peptide bound in an MHC molecule, such as binds to an MHC-peptide complex. In some cases, an antigen-binding portion or fragment of a TCR can contain only a portion of the structural domains of a full-length or intact TCR, but yet is able to bind the peptide epitope, such as MHC-peptide complex, to which the full TCR binds. In some cases, an antigen-binding portion contains the variable domains of a TCR, such as variable a chain and variable b chain of a TCR, sufficient to form a binding site for binding to a specific MHC-peptide complex. Generally, the variable chains of a TCR contain complementarity determining regions involved in recognition of the peptide, MHC and/or MHC-peptide complex.

c. Multi-Targeting

In some embodiments, the cells used in connection with the provided methods, uses, articles of manufacture and compositions include cells employing multi-targeting strategies, such as expression of two or more genetically engineered receptors on the cell, each recognizing the same of a different antigen and typically each including a different intracellular signaling component. Such multi-targeting strategies are described, for example, in WO 2014055668 (describing combinations of activating and costimulatory CARs, e.g., targeting two different antigens present individually on off-target, e.g., normal cells, but present together only on cells of the disease or condition to be treated) and Fedorov et al., Sci. Transl. Medicine, 5(215) (2013) (describing cells expressing an activating and an inhibitory CAR, such as those in which the activating CAR binds to one antigen expressed on both normal or non-diseased cells and cells of the disease or condition to be treated, and the inhibitory CAR binds to another antigen expressed only on the normal cells or cells which it is not desired to treat).

For example, in some embodiments, the cells include a receptor expressing a first genetically engineered antigen receptor (e.g., CAR) which is capable of inducing an activating or stimulatory signal to the cell, generally upon specific binding to the antigen recognized by the first receptor, e.g., the first antigen. In some embodiments, the cell further includes a second genetically engineered antigen receptor (e.g., CAR), e.g., a chimeric costimulatory receptor, which is capable of inducing a costimulatory signal to the immune cell, generally upon specific binding to a second antigen recognized by the second receptor. In some embodiments, the first antigen and second antigen are the same. In some embodiments, the first antigen and second antigen are different.

In some embodiments, the first and/or second genetically engineered antigen receptor (e.g. CAR) is capable of inducing an activating signal to the cell. In some embodiments, the receptor includes an intracellular signaling component containing ITAM or ITAM-like motifs. In some embodiments, the activation induced by the first receptor involves a signal transduction or change in protein expression in the cell resulting in initiation of an immune response, such as ITAM phosphorylation and/or initiation of IT AM-mediated signal transduction cascade, formation of an immunological synapse and/or clustering of molecules near the bound receptor (e.g. CD4 or CD8, etc.), activation of one or more transcription factors, such as NF-KB and/or AP-1, and/or induction of gene expression of factors such as cytokines, proliferation, and/or survival.

In some embodiments, the first and/or second receptor includes intracellular signaling domains or regions of costimulatory receptors such as CD28, CD137 (4-1 BB), OX40, and/or ICOS. In some embodiments, the first and second receptor include an intracellular signaling domain of a costimulatory receptor that are different. In one embodiment, the first receptor contains a CD28 costimulatory signaling region and the second receptor contain a 4-IBB co-stimulatory signaling region or vice versa.

In some embodiments, the first and/or second receptor includes both an intracellular signaling domain containing ITAM or ITAM-like motifs and an intracellular signaling domain of a costimulatory receptor.

In some embodiments, the first receptor contains an intracellular signaling domain containing ITAM or IT AM-like motifs and the second receptor contains an intracellular signaling domain of a costimulatory receptor. The costimulatory signal in combination with the activating signal induced in the same cell is one that results in an immune response, such as a robust and sustained immune response, such as increased gene expression, secretion of cytokines and other factors, and T cell mediated effector functions such as cell killing.

In some embodiments, neither ligation of the first receptor alone nor ligation of the second receptor alone induces a robust immune response. In some aspects, if only one receptor is ligated, the cell becomes tolerized or unresponsive to antigen, or inhibited, and/or is not induced to proliferate or secrete factors or carry out effector functions. In some such embodiments, however, when the plurality of receptors are ligated, such as upon encounter of a cell expressing the first and second antigens, a desired response is achieved, such as full immune activation or stimulation, e.g., as indicated by secretion of one or more cytokine, proliferation, persistence, and/or carrying out an immune effector function such as cytotoxic killing of a target cell.

In some embodiments, the two receptors induce, respectively, an activating and an inhibitory signal to the cell, such that binding by one of the receptor to its antigen activates the cell or induces a response, but binding by the second inhibitory receptor to its antigen induces a signal that suppresses or dampens that response. Examples are combinations of activating CARs and inhibitory CARs or iCARs. Such a strategy may be used, for example, in which the activating CAR binds an antigen expressed in a disease or condition but which is also expressed on normal cells, and the inhibitory receptor binds to a separate antigen which is expressed on the normal cells but not cells of the disease or condition.

In some embodiments, the multi-targeting strategy is employed in a case where an antigen associated with a particular disease or condition is expressed on a non-diseased cell and/or is expressed on the engineered cell itself, either transiently (e.g., upon stimulation in association with genetic engineering) or permanently. In such cases, by requiring ligation of two separate and individually specific antigen receptors, specificity, selectivity, and/or efficacy may be improved.

In some embodiments, the plurality of antigens, e.g., the first and second antigens, are expressed on the cell, tissue, or disease or condition being targeted, such as on the cancer cell. In some aspects, the cell, tissue, disease or condition is multiple myeloma or a multiple myeloma cell. In some embodiments, one or more of the plurality of antigens generally also is expressed on a cell which it is not desired to target with the cell therapy, such as a normal or non-diseased cell or tissue, and/or the engineered cells themselves. In such embodiments, by requiring ligation of multiple receptors to achieve a response of the cell, specificity and/or efficacy is achieved.

d. Chimeric Auto-Antibody Receptor (CAAR)

In some embodiments, the recombinant receptor is a chimeric autoantibody receptor (CAAR). In some embodiments, the CAAR binds, e.g., specifically binds, or recognizes, an autoantibody. In some embodiments, a cell expressing the CAAR, such as a T cell engineered to express a CAAR, can be used to bind to and kill autoantibody-expressing cells, but not normal antibody expressing cells. In some embodiments, CAAR-expressing cells can be used to treat an autoimmune disease associated with expression of self-antigens, such as autoimmune diseases. In some embodiments, CAAR-expressing cells can target B cells that ultimately produce the autoantibodies and display the autoantibodies on their cell surfaces, mark these B cells as disease-specific targets for therapeutic intervention. In some embodiments, CAAR-expressing cells can be used to efficiently targeting and killing the pathogenic B cells in autoimmune diseases by targeting the disease-causing B cells using an antigen-specific chimeric autoantibody receptor. In some embodiments, the recombinant receptor is a CAAR, such as any described in U.S. Patent Application Pub. No. US 2017/0051035.

In some embodiments, the CAAR comprises an autoantibody binding domain, a transmembrane domain, and one or more intracellular signaling region or domain (also interchangeably called a cytoplasmic signaling domain or region). In some embodiments, the intracellular signaling region comprises an intracellular signaling domain. In some embodiments, the intracellular signaling domain is or comprises a primary signaling domain, a signaling domain that is capable of stimulating and/or inducing a primary activation signal in a T cell, a signaling domain of a T cell receptor (TCR) component (e.g. an intracellular signaling domain or region of a CD3-zeta) chain or a functional variant or signaling portion thereof), and/or a signaling domain comprising an immunoreceptor tyrosine-based activation motif (ITAM).

In some embodiments, the autoantibody binding domain comprises an autoantigen or a fragment thereof. The choice of autoantigen can depend upon the type of autoantibody being targeted. For example, the autoantigen may be chosen because it recognizes an autoantibody on a target cell, such as a B cell, associated with a particular disease state, e.g. an autoimmune disease, such as an autoantibody-mediated autoimmune disease. In some embodiments, the autoimmune disease includes pemphigus vulgaris (PV). Exemplary autoantigens include desmoglein 1 (DsgI) and Dsg3.

In some embodiments, the encoded nucleic acid is operatively linked to a "positive target cell-specific regulatory element" (or positive TCSRE). In some embodiments, the positive TCSRE is a functional nucleic acid sequence. In some embodiments, the positive TCSRE comprises a promoter or enhancer. In some embodiments, the TCSRE is a nucleic acid sequence that increases the level of an exogenous agent in a target cell. In some embodiments, the positive target cell-specific regulatory element comprises a T cell-specific promoter, a T cell-specific enhancer, a T cell-specific splice site, a T cell-specific site extending half-life of an RNA or protein, a T cell-specific mRNA nuclear export promoting site, a T cell-specific translational enhancing site, or a T cell-specific post-translational modification site. In some embodiments, the T cell-specific promoter is a promoter described in Immgen consortium, herein incorporated by reference in its entirety, e.g., the T cell-specific promoter is an IL2RA (CD25), LRRC32, FOXP3, or IKZF2 promoter. In some embodiments, the T cell-specific promoter or enhancer is a promoter or enhancer described in Schmidl et al, Blood. 2014 Apr. 24; 123(17): e68-78, herein incorporated by reference in its entirety. In some embodiments, the T cell-specific promoter is a transcriptionally active fragment of any of the foregoing. In some embodiments, the T-cell specific promoter is a variant having at least 70%, 75%, 80%, 85%, 90%, 95%, 96%, 97%, 98%, or 99% identity to any of the foregoing.

In some embodiments, the encoded nucleic acid is operatively linked to a "negative target cell-specific regulatory element" (or negative TCSRE). In some embodiments, the negative TCSRE is a functional nucleic acid sequence. In some embodiments, the negative TCSRE is a miRNA recognition site that causes degradation of inhibition of the viral vector in a non-target cell. In some embodiments, the exogenous agent is operatively linked to a "non-target cell-specific regulatory element" (or NTCSRE). In some embodiments, the NTCSRE comprises a nucleic acid sequence that decreases the level of an exogenous agent in a non-target cell compared to in a target cell. In some embodiments, the NTCSRE comprises a non-target cell-specific miRNA recognition sequence, non-target cell-specific protease recognition site, non-target cell-specific ubiquitin ligase site, non-target cell-specific transcriptional repression site, or non-target cell-specific epigenetic repression site. In some embodiments, the NTCSRE comprises a tissue-specific miRNA recognition sequence, tissue-specific protease recognition site, tissue-specific ubiquitin ligase site, tissue-specific transcriptional repression site, or tissue-specific epigenetic repression site. In some embodiments, the NTCSRE comprises a non-target cell-specific miRNA recognition sequence, non-target cell-specific protease recognition site, non-target cell-specific ubiquitin ligase site, non-target cell-specific transcriptional repression site, or non-target cell-specific epigenetic repression site. In some embodiments, the NTCSRE comprises a non-target cell-specific miRNA recognition sequence and the miRNA recognition sequence is able to be bound by one or more of miR3 1, miR363, or miR29c. In some embodiments, the NTCSRE is situated or encoded within a transcribed region encoding the exogenous agent, optionally wherein an RNA produced by the transcribed region comprises the miRNA recognition sequence within a UTR or coding region.

In some embodiments, the viral vector comprising an anti-CD8 scFv or sdAb composition described herein can be administered to a subject, e.g., a mammal, e.g., a human. In such embodiments, the subject may be at risk of, may have a symptom of, or may be diagnosed with or identified as having, a particular disease or condition (e.g., a disease or condition described herein).

In some aspects, resting or non-activated T cells are contacted with a viral vector of the disclosure (e.g., a retroviral vector or lentiviral vector) that includes a CD8 binding agent. The contacting may be performed in vitro (e.g., with T cells derived from a healthy donor or a donor in need of cellular therapy) or in vivo by administration of the viral vector to a subject.

In some embodiments, the resting or non-activated T cells are not treated with one or more T cell stimulatory molecules (e.g., an anti CD-3 antibody), one or more T cell costimulatory molecules, and/or one or more T cell activating cytokines. In some embodiments, the resting or non-activated T cells are not treated with any of one or more T cell stimulatory molecules (e.g., an anti CD-3 antibody), one or more T cell costimulatory molecules, and/or one or more T cell activating cytokines.

In additional aspects, the application includes methods of administration to a subject of a viral vector that includes an anti-CD8 binding agent, wherein the subject is not administered or has not been administered a T cell activating treatment. In some embodiments, the T cell activating treatment includes one or more T cell stimulatory molecules (e.g., an anti CD-3 antibody), one or more T cell costimulatory molecules, and/or one or more T cell activating cytokines. In some embodiments, the subject is not administered or has not been administered any of one or more T cell stimulatory molecules (e.g., an anti CD-3 antibody), one or more T cell costimulatory molecules, and/or one or more T cell activating cytokines. In some embodiments, the T cell activating treatment is lymphodepletion. In certain embodiments, the subject is not administered or has not been administered the T cell activating treatment within 1 month before or after administration of the viral vector. In some embodiments, the subject is not administered or has not been administered the T cell activating treatment within 1 month before administration of the viral vector, such as within or at or about 4 weeks, 3 weeks, 2 weeks or 1 weeks, such as at or about 1 day, 2 days, 3 days, 4 days, 5 days, 6 days or 7 days before administration of the viral vector. In some embodiments, the subject is not administered the T cell activating treatment within 1 month after administration of the viral vector, such as within or at or about 4 weeks, 3 weeks, 2 weeks or 1 weeks, such as at or about 1 day, 2 days, 3 days, 4 days, 5 days, 6 days or 7 days after administration of the viral vector.

In some aspects, the viral vectors of the disclosure do not include one or more T cell stimulatory molecules (e.g., an anti CD-3 antibody), one or more T cell costimulatory molecules, and/or one or more T cell activating cytokines.

The use of anti-CD3 antibodies is well-known for activation of T cells. The anti-CD3 antibodies can be of any species, e.g., mouse, rabbit, human, humanized, or camelid. Exemplary antibodies include OKT3, CRIS-7, I2C the anti-CD3 antibody included in DYNABEADS Human T-Activator CD3/CD28 (Thermo Fisher), and the anti-CD3 domains of approved and clinically studied molecules such as blinatumomab, catumaxomab, fotetuzumab, teclistamab, ertumaxomab, epcoritamab, talquetamab, odronextamab, cibistamab, obrindatamab, tidutamab, duvortuxizumab, solitomab, eluvixtamab, pavurutamab, tepoditamab, vibecotamab, plamotamab, glofitamab, etevritamab, and tarlatamab.

In some embodiments, the one or more T cell costimulatory molecules include CD28 ligands (e.g., CD80 and CD86); antibodies that bind to CD28 such as CD28.2, the anti-CD28 antibody included in DYNABEADS Human T-Activator CD3/CD28 (Thermo Fisher) and anti-CD28 domains disclosed in US2020/0199234, US2020/0223925, US2020/0181260, US2020/0239576, US2020/0199233, US2019/0389951, US2020/0299388, US2020/0399369, and US2020/0140552; CD137 ligand (CD137L); anti-CD137 antibodies such as urelumab and utomilumab; ICOS ligand (ICOS-L); and anti-ICOS antibodies such as feladilimab, vopratelimab, and the anti-ICOS domain of izuralimab.

In some embodiments, the one or more T cell activating cytokines include IL-2, IL-7, IL-15, IL-21, interferons (e.g., interferon-gamma), and functional variants and modified versions thereof.

Lymhpodepletion may be induced by various treatments that destroy lymphocytes and T cells in the subject. For example, the lymphodepletion may include myeloablative chemotherapies, such as fludarabine, cyclophosphamide, bendamustine, and combinations thereof. Lymphodepletion may also be induced by irradiation (e.g., full-body irradiation) of the subject.

In some embodiments, the source of targeted lipid particles are from the same subject that is administered a targeted viral vector composition. In other embodiments, they are different. In some embodiments, the source of targeted viral vectors and recipient tissue may be autologous (from the same subject) or heterologous (from different subjects). In some embodiments, the donor tissue for targeted viral vector compositions described herein may be a different tissue type than the recipient tissue. In some embodiments, the donor tissue may be muscular tissue and the recipient tissue may be connective tissue (e.g., adipose tissue). In other embodiments, the donor tissue and recipient tissue may be of the same or different type, but from different organ systems.

In some embodiments, the targeted lipid particles (e.g., viral vector) composition described herein may be administered to a subject having a cancer, an autoimmune disease, an infectious disease, a metabolic disease, a neurodegenerative disease, or a genetic disease (e.g., enzyme deficiency). In some embodiments, the subject is in need of regeneration.

In some embodiments, the cancer is a T cell-mediated cancer. In another embodiment, the antigen binding moiety portion of a CAR is designed to treat a particular cancer. In some embodiments, the targeted viral vector can be used to treat cancers and disorders including but are not limited to Non-Hodgkin lymphoma (NHL), acute lymphocytic leukemia (ALL), chronic lymphocytic leukemia (CLL), multiple myeloma, and the like. I some embodiments, the targeted viral vector can be used to treat B cell malignancies, e.g., refractory B cell malignincies.

In some embodiments, the targeted viral vector is co-administered with an inhibitor of a protein that inhibits membrane fusion. For example, Suppressyn is a human protein that inhibits cell-cell fusion (Sugimoto et al., "A novel human endogenous retroviral protein inhibits cell-cell fusion" Scientific Reports 3: 1462 DOI: 10.1038/srep01462). In some embodiments, the targeted lipid particle is co-administered with an inhibitor of sypressyn, e.g., a siRNA or inhibitory antibody.

EXAMPLES

The present disclosure may be further described by the following non-limiting examples, in which standard techniques known to the skilled artisan and techniques analogous to those described in these examples may be used where appropriate. It is understood that the skilled artisan will envision additional embodiments consistent with the disclosure provided herein.

Example 1: Characterization of CD8 scFvs and VHH

This example describes methods to generate and characterize functional titers of Nipah G/F pseudo-typed lentivirus functionalized with a CD8-specific scFv or VHH. Eli ing binding of Nipah G to EphrinB2/B3 and functionalizing Nipah G with a CD8-specific binder allows for targeting of CD8-expressing cells with the lentiviral vector.

Lentiviral production was performed as follows: HEK-293LX cells were plated 24 hours in advance of transfection. On the day of transfection, HEK-293LX cells were transfected with a lentiviral packaging plasmid, a lentiviral transfer plasmid encoding GFP (pSFFV-GFP), and plasmids encoding for Nipah G protein retargeted for CD8 receptor targeting (NiV-G(CD8)) and Nipah F fusion protein (NiV-Fd22). After 24 hours, a media change was performed, and after another 24 hours, the lentivirus was harvested. To harvest the lentivirus, supernatant was removed from the HEK293LX cells and spun at 1000×g for 5 minutes. The supernatant was removed and immediately added to CD8-positive target cells or T cells, or frozen at −80° C. for later use.

Several cell lines were used to characterize specificity and transduction efficiency of the lentiviral vectors described above. A SupT1 CD8αβ knockout line was generated from SupT1 human T lymphoblast cells. On the day of transduction, SupT1 and SupT1 CD8αβ knock out cells, HEK293LX cells expressing M. nemestrina CD8αβ and HEK293LX background lines were plated in a 96 well cell plate. Two hours later, the lentivirus was serial diluted and added to the recipient cells. The lentivirus and cells were incubated at 37° C. at 5% CO2 for three days and analyzed by flow cytometry for GFP expression. Briefly, HEK293LX and HEK293LX cells overexpressing M. nemestrina CD8αβ cells were harvested from the 96-well cell plate by trypsinization, transferred to a 96-well U-bottom sample plate, and pelleted by centrifugation at 1000×g for 5 min. The cells were then resuspended in 200 μL of PBS before flow cytometry analysis. SupT1 and SupT1 CD8αβ knock-out cells were pelleted by centrifugation and resuspended in 200 uL PBS+2% FBS for flow cytometry analysis.

Figure 1B:
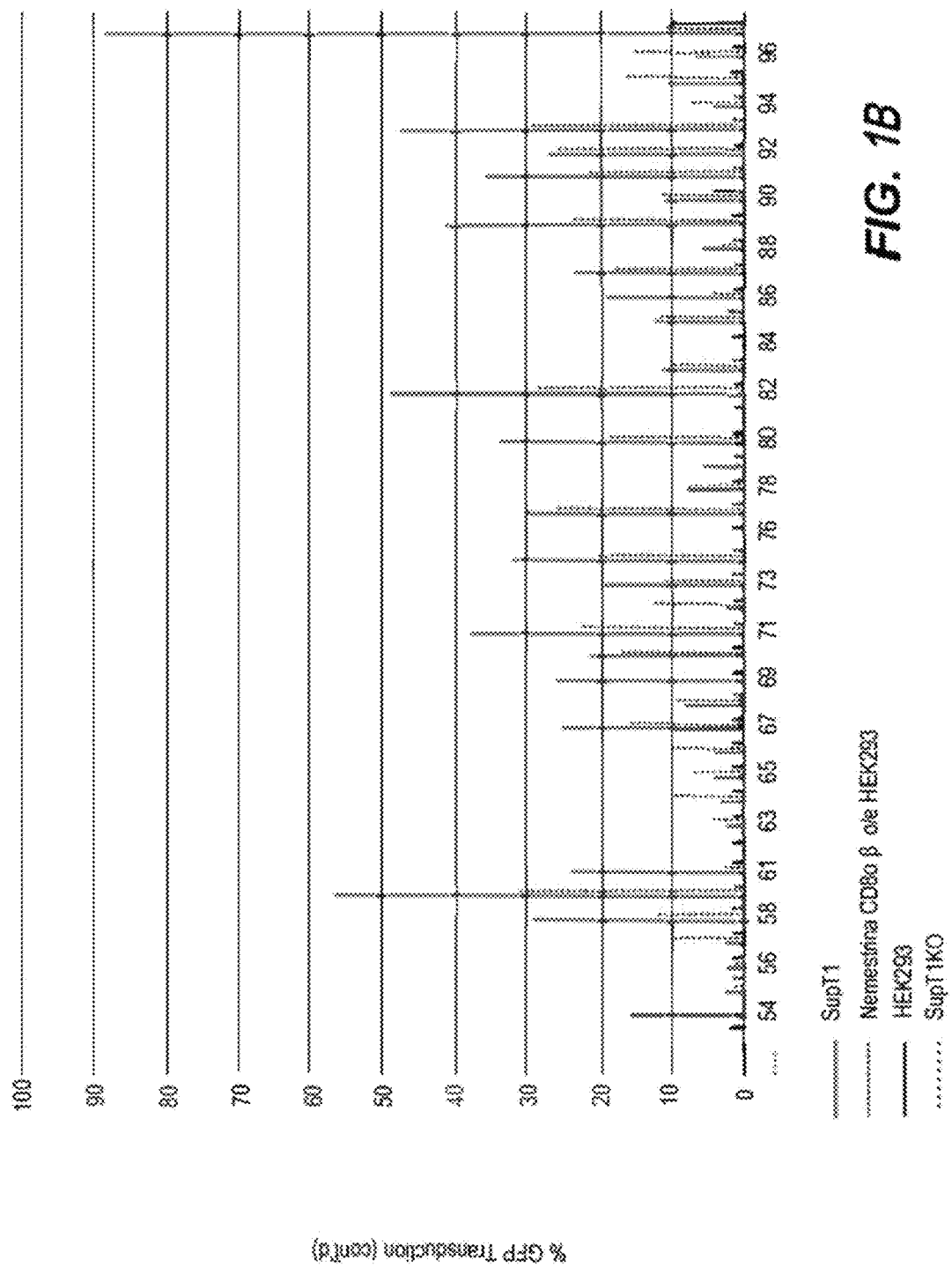

The cells were measured for GFP fluorescence using a BD Celesta cytometer. GFP was excited with a 488 nm laser and emission captured at 513±26 nm. Forward and side scatter gating was initially used to capture cell-sized events and discard small debris. Events positive for GFP were determined by gating at the minimum level for which the negative control cell samples (cells not treated with lentivirus) showed <0.5% of events positive for GFP expression. The gated cells positive for GFP fluorescence were then assessed for the % of GFP-positive cells of the total cells. To calculate lentiviral functional titer, a transduced cell well showing a GFP % positive that was between 5% and 20% of cells was used to determine titer. The formula for virus titer calculation: titer={(F×Cn)/V}×DF. F is the frequency of GFP-positive cells determined by flow cytometry; Cn=The total number of target cells infected. V=The volume of the inoculum, and DF=dilution factor (see FIG. 1).

Figure 2:
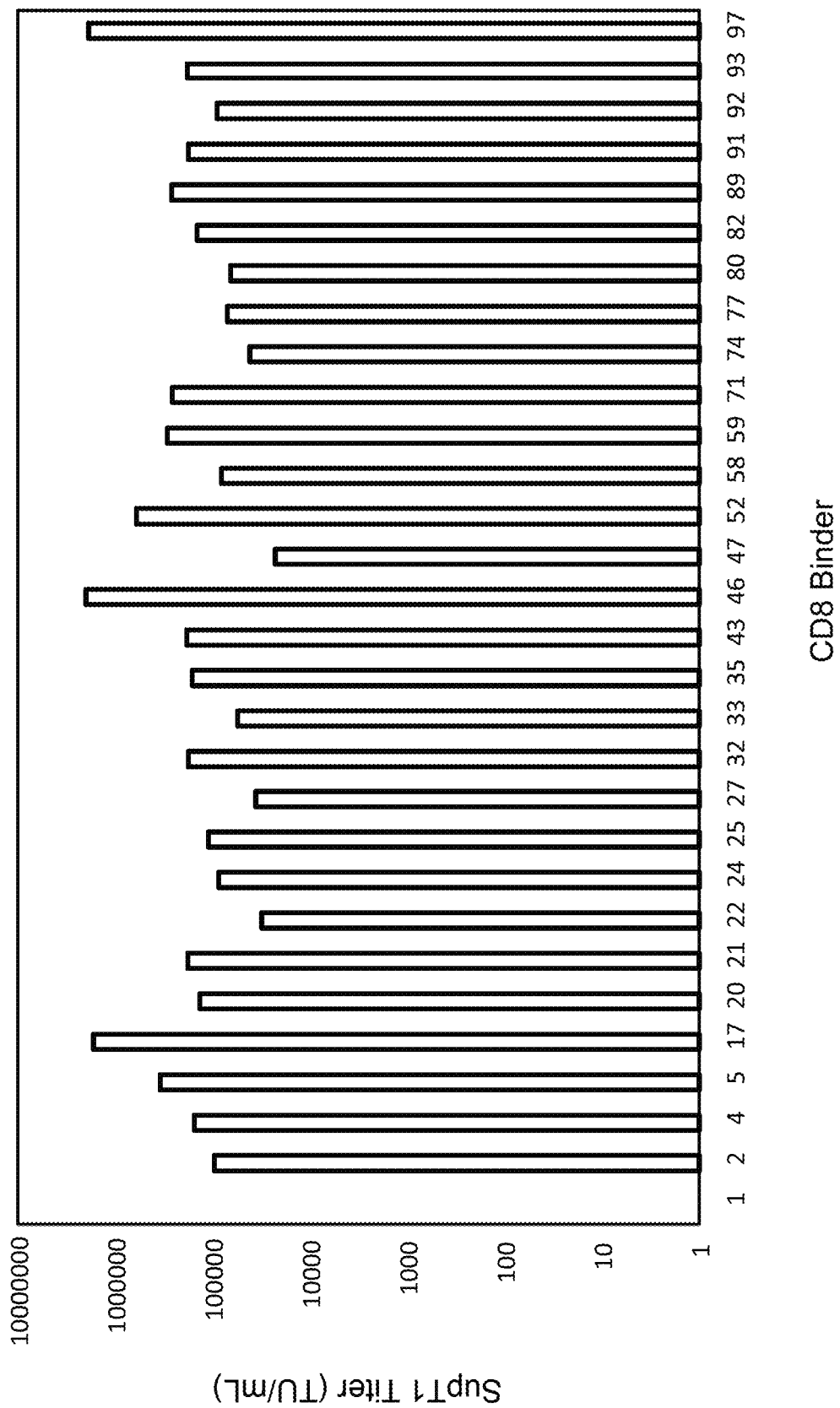
FIG. 2 shows the titers of the disclosed anti-CD8 antibodies on SupT1 cells.

Lentivirus with CD8 binders 97 (VHH) and 46 (scFv) were further tested on additional non-CD8-expressing cell lines and the CD8 positive cell line SupT1 as above (see FIG. 2). Maximal transduction of the cells over various dilution factors is indicated below (Table 15). VSV-G was used as a non-cell specific control. These results indicate that the binders are specific for CD8.

TABLE 15

|  | CD8 Binder 97 | CD8 Binder 46 | VSV-G |
| --- | --- | --- | --- |
| SupT1 | 87.0 | 99.0 | 98.0 |
| 293 Lenti-X | 6.0 | 3.0 | 81.0 |

TABLE 15-continued

|  | CD8 Binder 97 | CD8 Binder 46 | VSV-G |
| --- | --- | --- | --- |
| Ramos | 9.0 | 4.0 | 68.0 |
| HUVEC | 10.0 | 5.0 | 94.0 |
| C2C12 | 0 | 0 | 63.0 |
| HEL 92.1.7 | 0 | 2.0 | 100.0 |
| HeLa | 1.0 | 0 | 97.0 |
| HepG2 | 0 | 0 | 99.0 |
| hFOB | 0.1 | 0.6 | 68.3 |
| HULEC-5a | 2.0 | 4.0 | 83.0 |
| Kasumi 1 | 0 | 3.0 | 74.0 |
| SK-N-AS | 1.0 | 2.0 | 99.0 |
| U-937 | 0 | 0 | 100.0 |

Binding to human and M. nemestrina CD8 was also evaluated. On the day of transduction, SupT1 and SupT1 CD8αβ knockout cell lines, HEK293LX cells expressing M. nemestrina CD8αβ and HEK293LX background lines were plated in a 96 well cell plate. Two hours later, the lentivirus was serial diluted and added to the recipient cells. The lentivirus and cells were incubated at 37° C. at 5% CO2 for three days and analyzed by flow cytometry for GFP expression. Briefly, HEK293LX and HEK293LX cells overexpressing M. nemestrina CD8αβ cells were harvested from the 96-well cell plate by trypsinization, transferred to a 96-well U-bottom sample plate, and pelleted by centrifugation at 1000×g for 5 min. The cells were then resuspended in 200 μL of PBS before flow cytometry analysis. SupT1 and SupT1 CD8αβ knock-out cells were pelleted by centrifugation and resuspended in 200 uL PBS+2% FBS for flow cytometry analysis.

Figure 3:
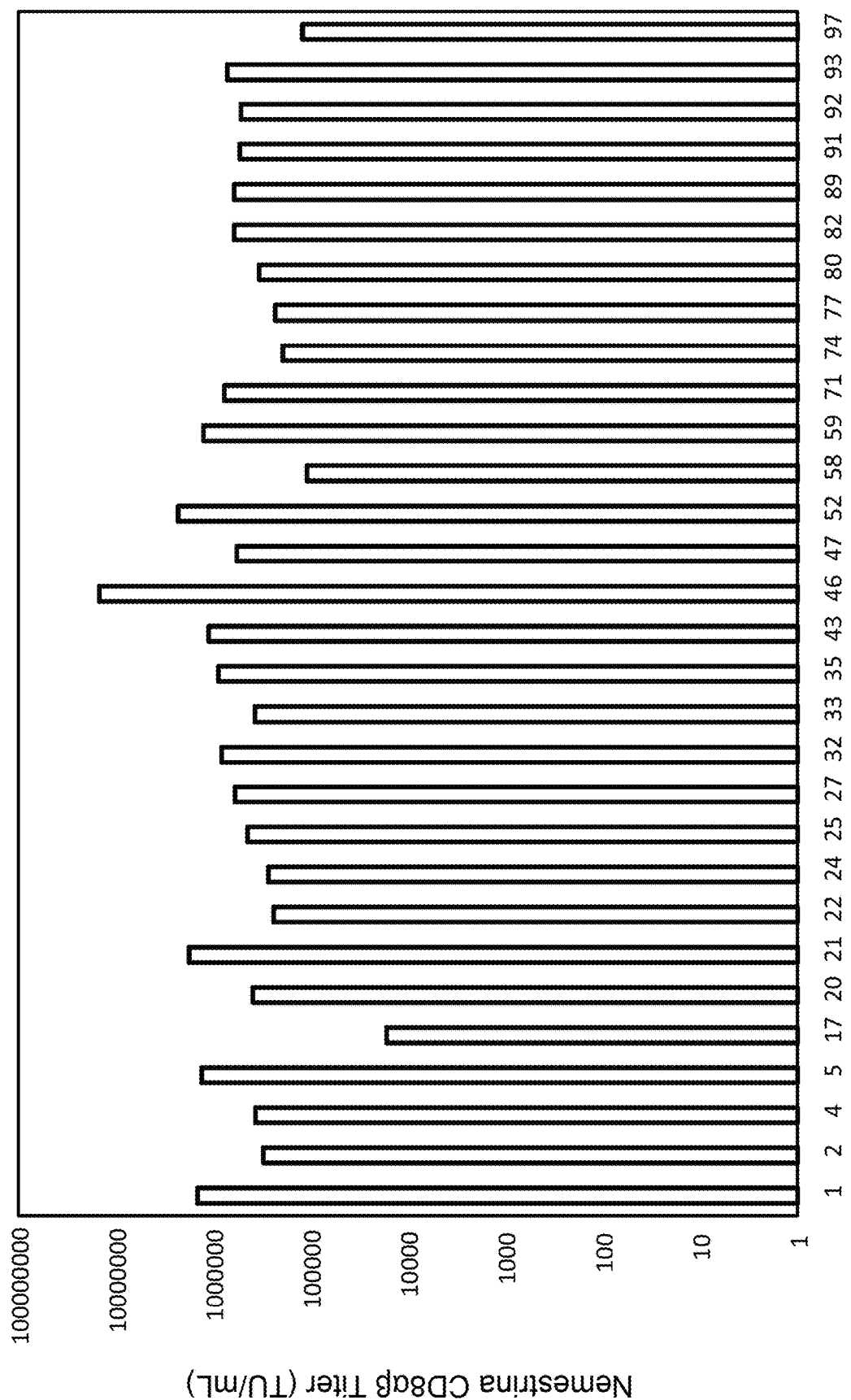
FIG. 3 shows the titers of the disclosed anti-CD8 antibodies on cells expressing M. nemestrina CD8α and CD8β.

The cells were measured for GFP fluorescence using a BD Celesta cytometer. GFP was excited with a 488 nm laser and emission captured at 513±26 nm. Forward and side scatter gating was initially used to capture cell-sized events and discard small debris. Events positive for GFP were determined by gating at the minimum level for which the negative control cell samples (cells not treated with lentivirus) showed <0.5% of events positive for GFP expression. The gated cells positive for GFP fluorescence were then assessed for the % of GFP-positive cells of the total cells. To calculate lentiviral functional titer, a transduced cell well showing a GFP % positive that was between 5% and 20% of cells was used to determine titer. The formula for virus titer calculation: titer={(F×Cn)/V}×DF. F is the frequency of GFP-positive cells determined by flow cytometry; Cn=The total number of target cells infected. V=The volume of the inoculum, and DF=dilution factor. Titer for human CD8 (SupT1) is presented in FIG. 2. Titer for M. nemestrina CD8 (HEK293LX cells expressing M. nemestrina CD8αβ) is presented in FIG. 3.

Lentiviral production was performed as follows: LV-Max HEK293 cells were seeded 24 hours in advance of transfection. On the day of transfection, LV-Max HEK293 cells were transfected with lentiviral packaging plasmid, the lentiviral transfer plasmid encoding GFP (pSFFV-GFP), and plasmids encoding Nipah G protein retargeted for CD8 receptor targeting (NiV-G(CD8)) and Nipah F fusion protein (NiV-Fd22). Two days later supernatant from the transfected cells was harvested, passed through a 0.45 μm filter, and concentrated by ultracentrifugation at 120,000×g for 90 minutes. After ultracentrifugation the lentiviral pellet was resuspended in PBS, and either used immediately for transduction or aliquoted and frozen at −80° C. for use later.

Human CD8α and human CD8αβ overexpressing cell lines were generated from HEK293LX cells. On the day of transduction, human CD8a, human CD8αβ overexpressing and HEK293LX background cell lines were plated in a 96 well cell plate. Two hours later, the lentivirus was serial diluted and added to the recipient cells. The lentivirus and cells were incubated at 37° C. at 5% CO2 for three days and analyzed by flow cytometry for GFP expression. Briefly, human CD8α, human CD8αβ overexpressing, and HEK293LX background cell lines were harvested from the 96-well cell plate by trypsinization, transferred to a 96-well U-bottom sample plate, and pelleted by centrifugation at 1000×g for 5 min. The cells were then resuspended in 200 μL of PBS before flow cytometry analysis.

Figure 4:
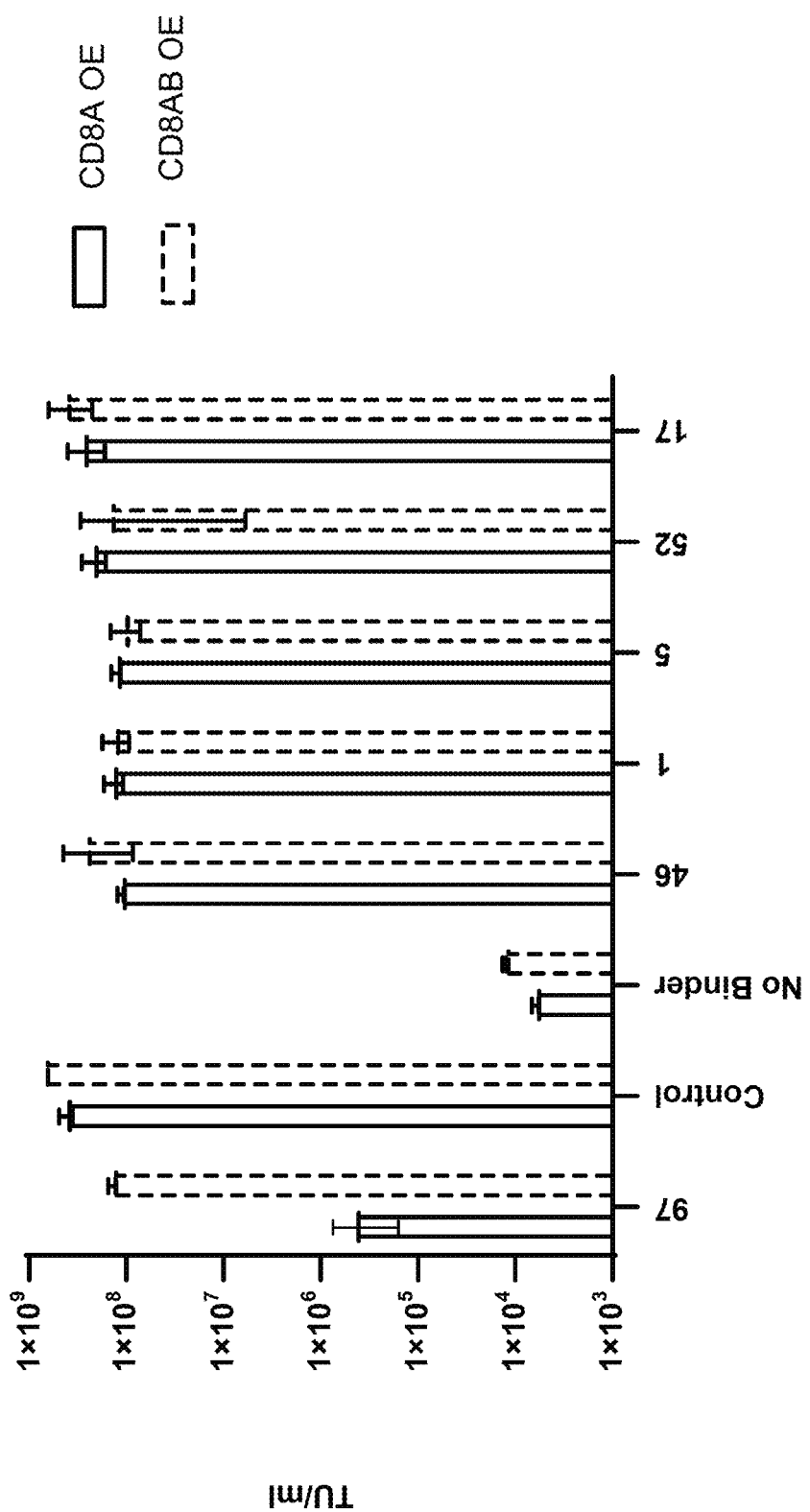
FIG. 4 shows the titers of select CD8 binders on CD8α only or CD8αβ overexpressing cells.
Figure 5:
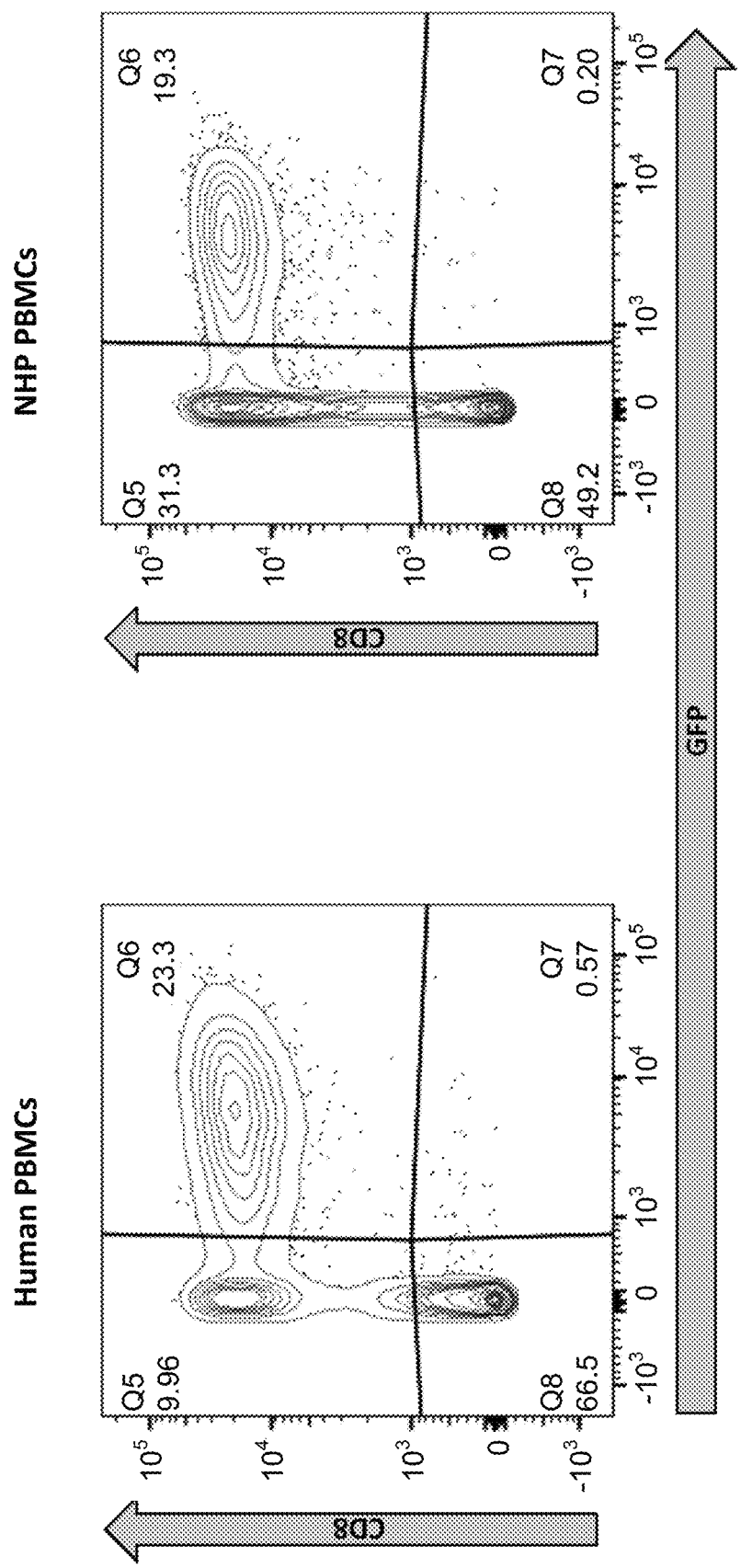
FIG. 5 shows the transduction efficiencies of a CD8 scFv (CD8 binder 52) of the disclosure on human or M. nemestrina (NHP) peripheral blood mononuclear cells (PBMCs).
Figure 6:
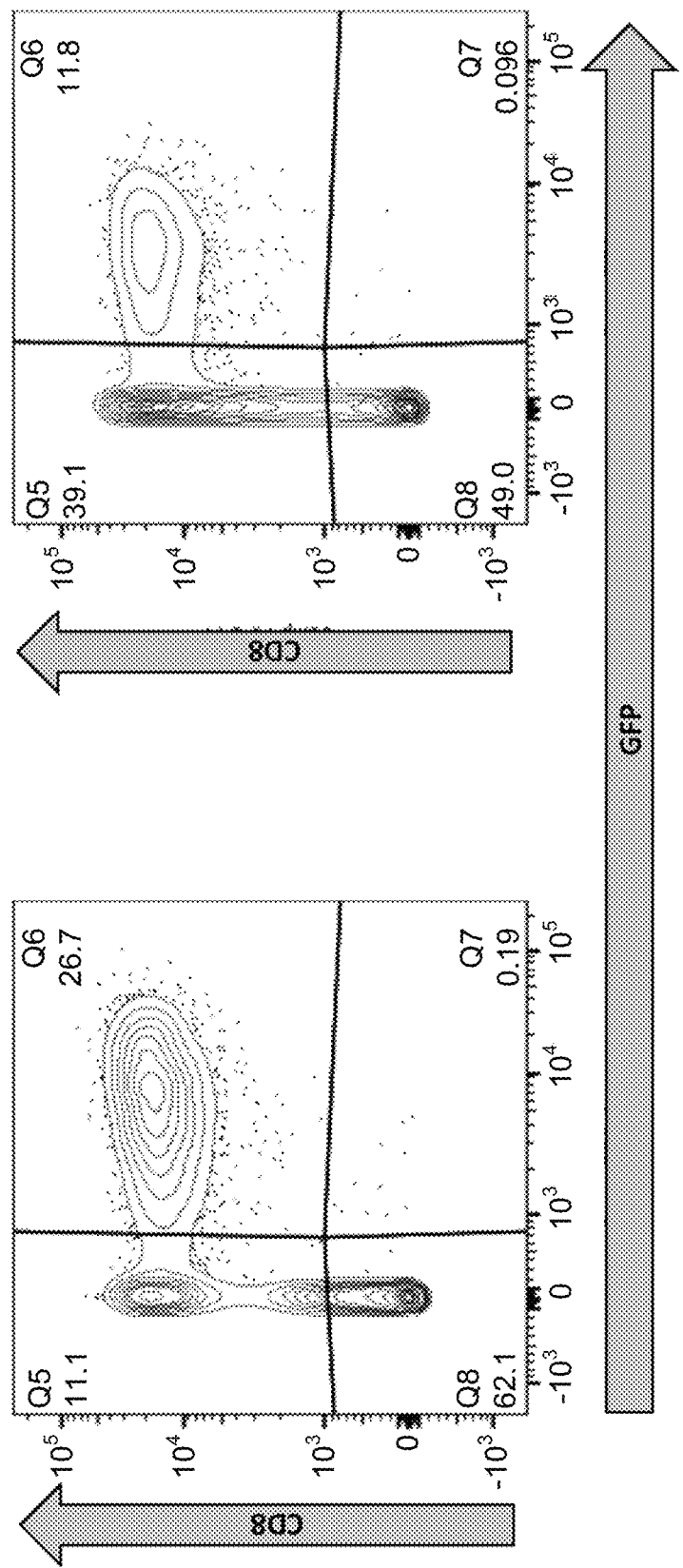
FIG. 6 shows the transduction efficiencies of a CD8 scFv (CD8 binder 46) of the disclosure on human or *M. nemestrina* (NHP) PBMCs.
Figures 9A, 9B:
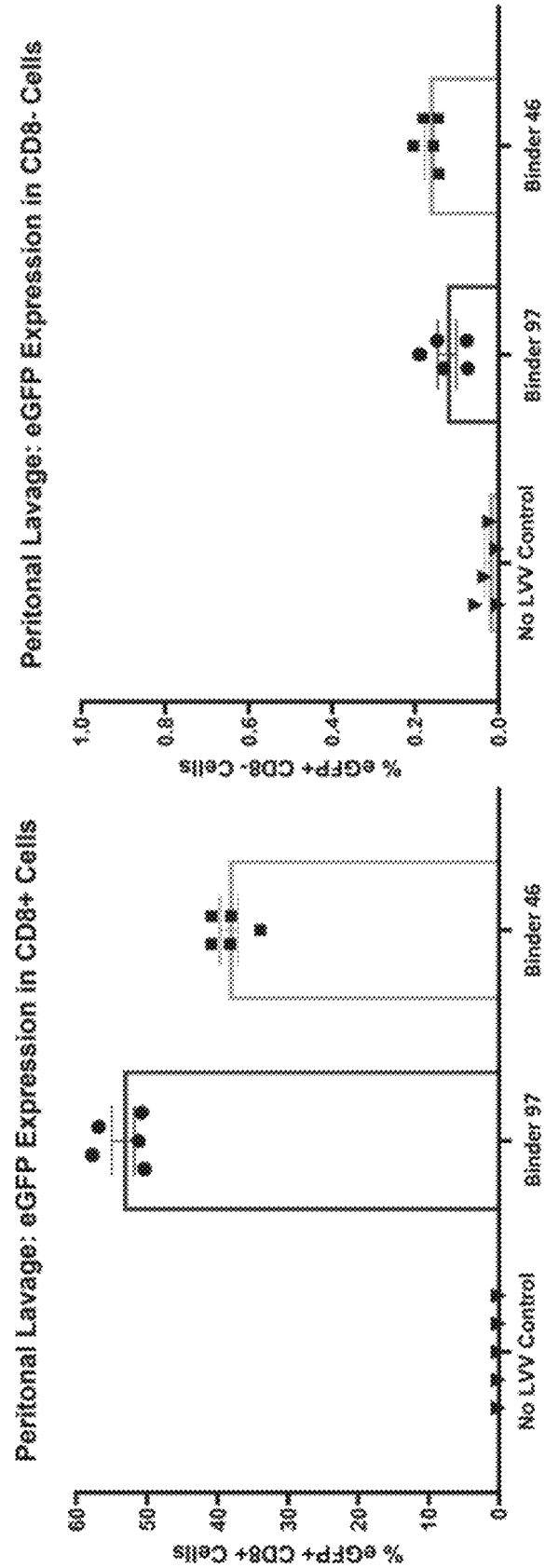
Figure 10B:
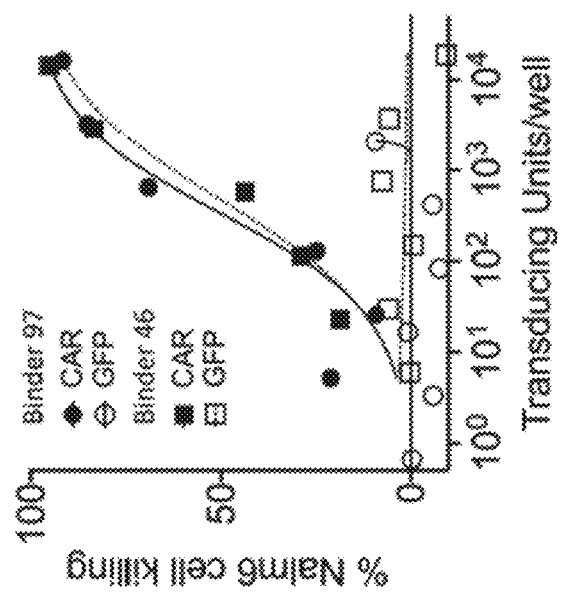
Figure 10A:
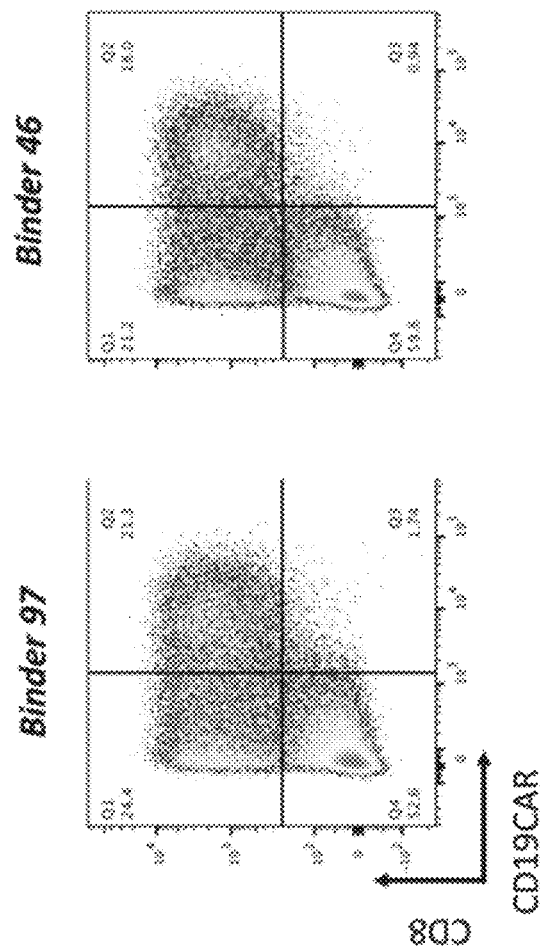

The cells were measured for GFP fluorescence using a BD Celesta cytometer. GFP was excited with a 488 nm laser and emission captured at 513±26 nm. Forward and side scatter gating was initially used to capture cell-sized events and discard small debris. Events positive for GFP were determined by gating at the minimum level for which the negative control cell samples (cells not treated with lentivirus) showed <0.5% of events positive for GFP expression. The gated cells positive for GFP fluorescence were then assessed for the % of GFP-positive cells of the total cells. To calculate lentiviral functional titer, a transduced cell well showing a GFP % positive that was between 5% and 20% of cells was used to determine titer. The formula for virus titer calculation: titer={(F×Cn)/V}×DF. F is the frequency of GFP-positive cells determined by flow cytometry; Cn=The total number of target cells infected. V=The volume of the inoculum, and DF=dilution factor. As shown in FIG. 4, CD8 binders 46, 1, 52, and 17 showed similar titer in human CD8α and human CD8αβ overexpressing cell lines, indicating that those binders are specific for CD8a. However, CD8 binder 97 had a significantly higher titer on human CD8αβ overexpressing cell lne as compared to the cell line expressing only CD8a, indicating that CD8 binder 97 is specific for CD8β.

Binding Assessment and Affinity Vs Human CD8αβ Heterodimer

Binders were generated as crude preparations of scFvs with a v5 tag and captured onto a Streptavidin BLI sensor that was functionalized with an anti-V5 tag antibody for analysis via a ForteBio Octet HTX instrument. Sensors were exposed to 300 nM of human CD8αβ followed by dissociation into assay buffer. A positive binding response was referenced by buffer subtraction with a negative control scFv and fit using a 1:1 Langmuir model to determine off-rates.

A subset of scFvs were produced as recombinant, purified scFv with a mIgG2a Fc tag. scFv-mIgG2a proteins were loaded onto anti-mouse Fc capture sensors for analysis via ForteBio Octet RED96 instrument. Sensors were exposed to a serial dilution of human CD8 alpha beta starting at 500 nM, followed by dissociation into assay buffer. A positive binding response was referenced by buffer subtraction and fit using a 1:1 Langmuir model to determine on and off-rates and calculate a $K_D$.

Binding Assessment Vs Human CD8α

Binders were generated as crude preparations of scFvs with a v5 tag and captured onto a HC200M SPRi sensor that was functionalized with an anti-V5 tag antibody for analysis via a Carterra LSA instrument. A serial dilution of human CD8α starting at 5 uM was injected over the sensor, followed by an injection of assay buffer for dissociation. A positive binding response was referenced by buffer subtraction with a negative control scFv and fit using a 1:1 Langmuir model to determine binding response.

Binding Assessment Vs Human CD8β

A subset of scFvs were produced as recombinant, purified scFv or VHH with a mIgG2a Fc tag. Human CD8β protein was biotinylated and loaded onto a Streptavidin sensor for analysis via ForteBio Octet RED96 instrument. Sensors were exposed to a serial dilution of concentrations of scFv-mIgG2a or VHH-mIgG2a starting at 500 nM, followed by dissociation into assay buffer. A positive binding response was referenced by buffer subtraction and fit using a 1:1 Langmuir model to determine on and off-rates and calculate a $K_D$.

Binding Assessment Vs Cyno CD8α Homodimer

Binders were generated as crude preparations of scFvs with a v5 tag and captured onto a HC200M SPRi sensor that was functionalized with an anti-V5 tag antibody for analysis via a Carterra LSA instrument. A serial dilution of cyno CD8α-hFc starting at 1 uM was injected over the sensor, followed by an injection of assay buffer for dissociation. A positive binding response was referenced by buffer subtraction with a negative control scFv and fit using a 1:1 Langmuir model to determine off-rates.

A subset of scFvs and VHH were produced as recombinant, purified scFv or VHH with a mIgG2a Fc tag. scFv-mIgG2a or VHH-mIgG2a proteins were loaded onto anti-mouse Fc capture sensors for analysis via ForteBio Octet RED96 instrument. Sensors were exposed to a serial dilution of concentrations of cyno CD8α-hFc starting at 500 nM, followed by dissociation into assay buffer. A positive binding response was referenced by buffer subtraction and fit using a 1:1 Langmuir model to determine on and off-rates and calculate a $K_D$.

The binding affinities of select CD8 binders are shown in Table 16.

TABLE 16

Binding summary of select CD8 scFvs.

| CD8 Binder | Crude Titers Sup1T1 (TU/mL) | Highest Response (nm) | $K_D$ (M) | $k_{on}$ (1/Ms) | $k_{off}$ (1/s) |
|---|---|---|---|---|---|
| 46 | 4.90E+06 | 0.4906 | 9.52E-08 | 8.63E+04 | 8.21E-03 |
| 1 | 1.05E+06 | 0.1334 | 2.03E-08 | 3.08E+04 | 6.23E-04 |
| 5 | 1.83E+06 | 0.2201 | 4.01E-07 | 3.84E+04 | 1.54E-02 |
| 97 | 3.47E+06 | 0.4651 | 5.30E-09 | 5.14E+04 | 2.72E-04 |

Example 2: Generation and Characterization of Viral Vectors Pseudotyped with CD8 Binders Methods for Generating Nipah G Pseudotyped Viruses This example describes methods to generate and characterize functional titers of Nipah G/F pseudo-typed lentivirus functionalized with a CD8-specific scFv or VHH. Eliminating binding of Nipah G to EphrinB2/B3 and functionalizing Nipah G with a CD8-specific binder allows for targeting of CD8-expressing cells with the lentiviral vector. Nipah G (d34, E501A; W504A; Q530A; E533A) was modified by the addition of a glycine/serine linker (G4Sx3) followed by a CD8-specific binder (scFv or VHH) at the C-terminus. The Nipah G-linker-binder construct was codon optimized for expression in human cells and sub-cloned into an expression vector for lentivirus generation.

Crude lentiviral production was performed as follows: HEK-293LX cells were plated 24 hours in advance of transfection. On the day of transfection, HEK-293LX cells were transfected with the lentiviral packaging plasmid (psPAX2), the lentiviral transfer plasmid encoding GFP (pSFFV-GFP), and the plasmids encoding for Nipah G protein retargeted for CD8 receptor targeting (NiV-G(CD8))

and Nipah F fusion protein (NiV-Fd22). After 24 hours, a media change was performed, and after another 24 hours, the lentivirus was harvested. To harvest the lentivirus, supernatant was removed from the HEK293LX cells and spun at 1000×g for 5 minutes. The supernatant was removed and immediately added to CD8-positive target cells or T cells, or frozen at −80° C. for later use.

Concentrated lentiviral production was performed as follows: LV-Max HEK293 cells were seeded 24 hours in advance of transfection. On the day of transfection, LV-Max HEK293 cells were transfected with the lentiviral packaging plasmid (psPAX2), the lentiviral transfer plasmid encoding GFP (pSFFV-GFP), and the plasmids encoding for Nipah G protein retargeted for CD8 receptor targeting (NiV-G(CD8)) and Nipah F fusion protein (NiV-Fd22). Two days later supernatant from the transfected cells was harvested, passed through a 0.45 μm filter, and concentrated by ultracentrifugation at 120,000×g for 90 minutes. After ultracentrifugation the lentiviral pellet was resuspended in PBS, and either used immediately for transduction or aliquoted and frozen at −80° C. for use later.

Transduction Efficiency on Human and Nemestrina Primary Cells

Lentiviral production was performed as follows: LV-Max HEK293 cells were seeded 24 hours in advance of transfection. On the day of transfection, LV-Max HEK293 cells were transfected with the lentiviral packaging plasmid (psPAX2), the lentiviral transfer plasmid encoding GFP (pSFFV-GFP), and the plasmids encoding for Nipah G protein retargeted for CD8 receptor targeting (NiV-G(CD8)) and Nipah F fusion protein (NiV-Fd22). Two days later supernatant from the transfected cells was harvested, passed through a 0.45 μm filter, and concentrated by ultracentrifugation at 120,000×g for 90 minutes. After ultracentrifugation the lentiviral pellet was resuspended in PBS, and either used immediately for transduction or aliquoted and frozen at −80° C. for use later.

Primary isolated Human PanT cells or PBMCs were obtained from StemCell Technologies and activated with anti-human CD3/CD28 with IL-2 supplemented in the media. *M. nemestrina* PBMCs were obtained from BioIVT and activated using anti-CD3/CD28 beads from Miltenyi Biotec with IL-2 supplemented in the media. 72 hours after activation, cells were harvested and plated in a 96-well plate. A serial dilution of lentivirus was performed and added to the primary PanT or PBMC cells. A spinfection was performed at 1000×g for 90 minutes at 25° C. The cells were then incubated at 37° C. with 5% CO2 for 72 hours. After 72 hours, cells were harvested via centrifugation at 1000×g for 5 minutes and stained with a live/dead exclusionary stain and an antibody panel to identify CD3 positive, CD8 positive and CD4 positive populations.

The cells were measured for GFP fluorescence using a BD Celesta cytometer. Forward and side scatter gating was initially used to capture cell-sized events and discard small debris. Forward scatter height and forward scatter width was used to capture single cells. Events negative for live/dead stain were selected. For PanT cells, cells were gated on either CD8 positive and GFP positive or CD4 negative and GFP positive to assess transduction in CD8-expressing cells. GFP expression in CD8 positive cells was calculated based upon the percent of cells expressing GFP from a CD8 positive population or CD4 negative population. Events positive for GFP were determined by gating at the minimum level for which the negative control cell samples (cells not treated with lentivirus) showed <0.5% of events positive for GFP expression. To calculate lentiviral functional titer, a transduced cell well showing a GFP % positive of CD8 positive cells that was between 5% and 20% of cells was used to determine titer. The formula for virus titer calculation: titer={(F×Cn)/V}×DF. F is the frequency of GFP-positive cells determined by flow cytometry; Cn=The total number of target cells infected. V=The volume of the inoculum, and DF=dilution factor.

For PBMC cells, cells were measured for GFP fluorescence using a BD Fortessa cytometer. Cells were gated to be CD3 positive, and then gated for either CD8 positive and GFP positive or CD4 negative and GFP positive to assess transduction in CD8-expressing cells. GFP expression in CD8 positive cells was calculated based upon the percent of cells expressing GFP from a CD8 positive population or CD4 negative population. Events positive for GFP were determined by gating at the minimum level for which the negative control cell samples (cells not treated with lentivirus) showed <0.5% of events positive for GFP expression. To calculate lentiviral functional titer, a transduced cell well showing a GFP positive % of CD8 positive cells that was between 5% and 20% of cells was used to determine titer. The formula for virus titer calculation: titer={(F×Cn)/V}×DF. F is the frequency of GFP-positive cells determined by flow cytometry; Cn=The total number of target cells infected. V=The volume of the inoculum, and DF=dilution factor (see FIGS. 5-8).

In Vivo Specificity

To demonstrate specific in vivo transduction, GFP-expressing lentivirus with CD8 binders 97 and 46 were produced as above and administered to mice. T cells in human PBMCs were activated for 3 days via CD3/CD28 treatment and 1E7 cells were intraperitoneally injected into NOD-scid-IL2rγ$^{null}$ mice. One day later 1E7 TU of CD8 fusosome (binder 97 or 46) or vehicle control were intraperitoneally injected. 7 days later peritoneal cells were harvested by peritoneal lavage and analyzed by flow cytometry for on-target GFP expression and off-target expression. Approximately 35-55% of the CD8+ cells in the mice were GFP positive following treatment with the CD8-targeted lentiviral vectors (FIG. 9A), whereas less than 0.2% of (FIG. 9B) were GFP positive, indicating CD8-specific transduction in the mice.

Tumor Killing

To evaluate tumor killing in vitro, human PBMC were activated with anti-CD3/CD28 reagent and cells were transduced with CD8-targeted fusosomes (VHH binder 97 or scFv binder 46) expressing CD19CAR or GFP. RFP+ Nalm6 cells were added to the cultures on day 3, and elimination of Nalm6 cells was evaluated by flow cytometry 18 hours after CD19CAR expression was detected specifically in CD8+ cells with both CD8 fusogens 4 days after transduction (FIG. 10A). Fusogen-generated CD19CAR T cells (solid symbols) mediated potent and fusosome dose-dependent killing of CD19-expressing Nalm6 cells. In contrast, fusogen generated GFP+ T cells (open symbols) did not exhibit target cell killing (FIG. 10B).

Example 3: In Vivo Delivery of a CD8 Targeted Fusogens in Nalm6 Tumor Models as a Function of T Cell Activation State This Example describes the assessment of the transduction efficiency of CD8 retargeted Nipah fusogens and VSV-G.

Briefly, sixty-two (62) female NSG mice were injected with 1E6 Nalm6-Luc leukemia B cells via intravenous (IV) injection, followed three days later by an IV injection of 2E6 human peripheral blood mononuclear cells (hPBMC), with or without prior T cell activation with CD3/CD28 complexes. A day after hPBMC injection, CD8 binder 97 Nipah fusogen pseudotyped lentiviral vector (LV) expressing a CD19 CAR were injected at a range of integrating units (IU), 2E6-5E7, into separate groups of animals. Nalm6 tumor progression was tracked via bioluminescent imaging (BLI) using the Lago X imaging system weekly throughout the duration of the study. The CD19CAR contained an anti-scFv directed against CD19 and an intracellular signaling domain containing intracellular components of 4-1 BB and CD3-zeta. Peripheral blood analysis was performed on half of the mice from each group to assess circulating T and B cell frequencies, circulating CAR-T cell frequencies, and cytokine levels throughout the duration of the study. The study was concluded 28 days post-h PBMC injection, or earlier based on individual animal health. Animals were sacrificed and cells from peripheral blood, spleen, and bone marrow tissues were harvested and analyzed by flow cytometry for CD19CAR expressing cells and cytokine analysis.

Figure 11A:
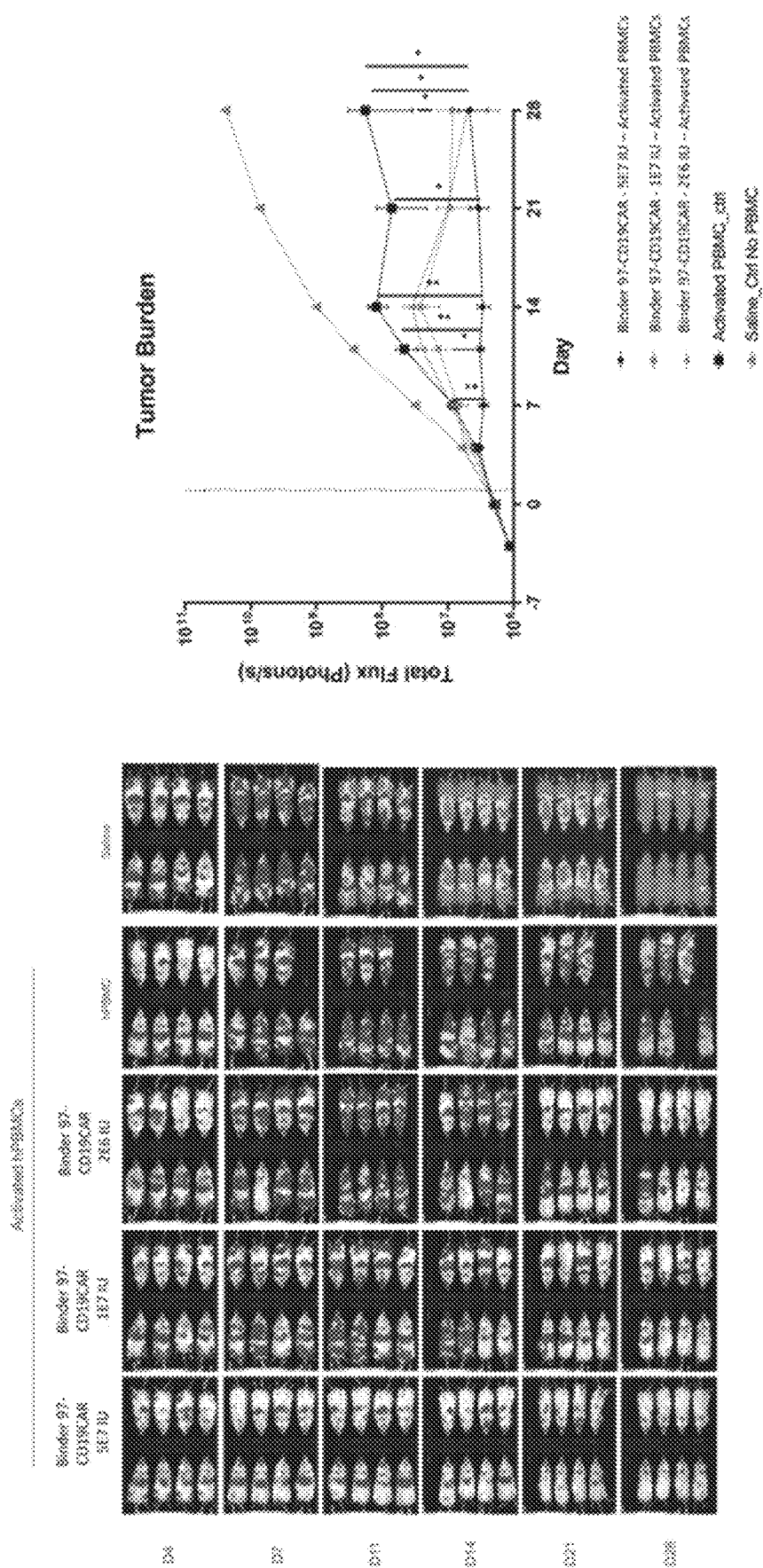
Figure 11B:
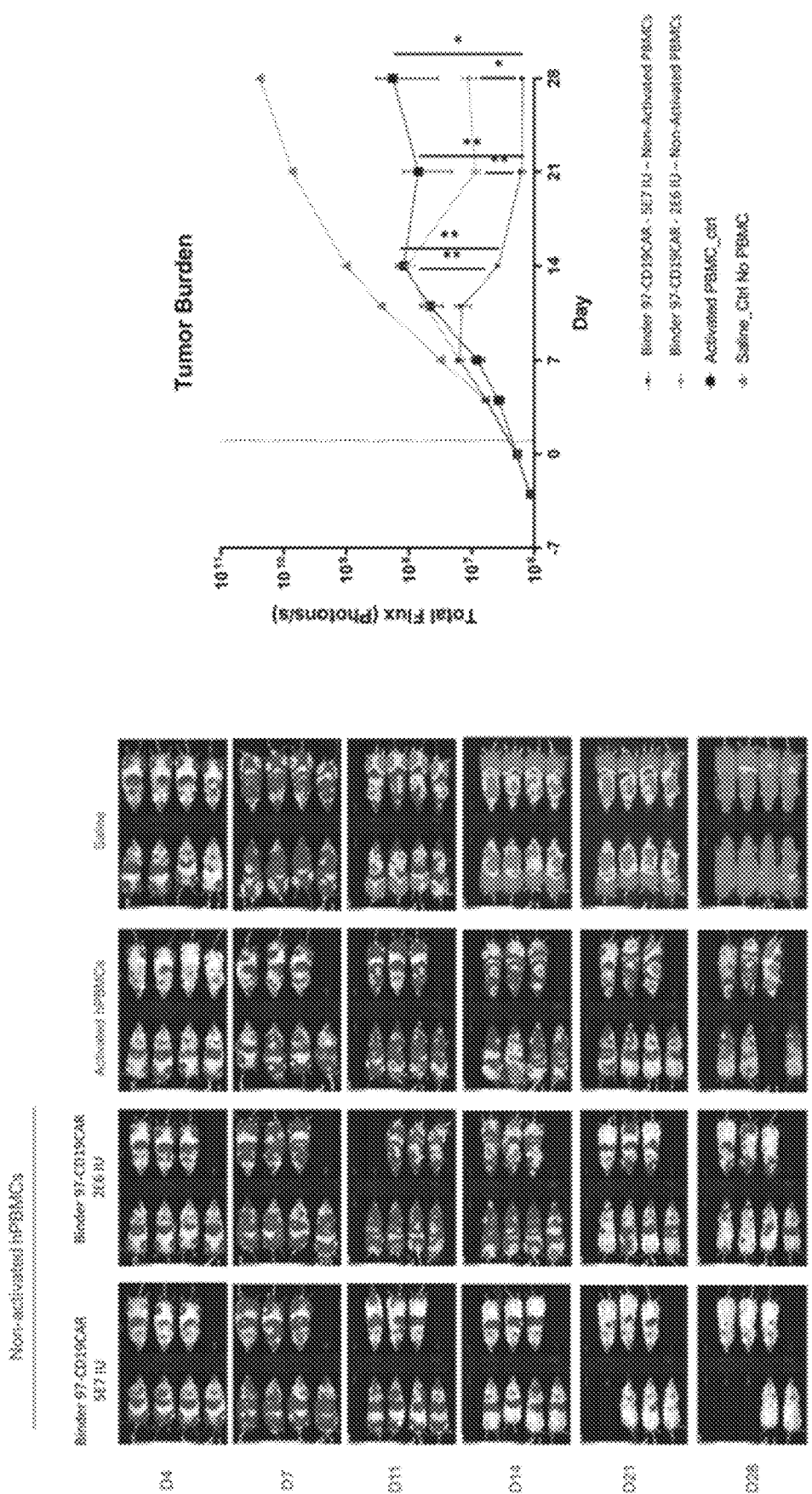
Figure 11C:
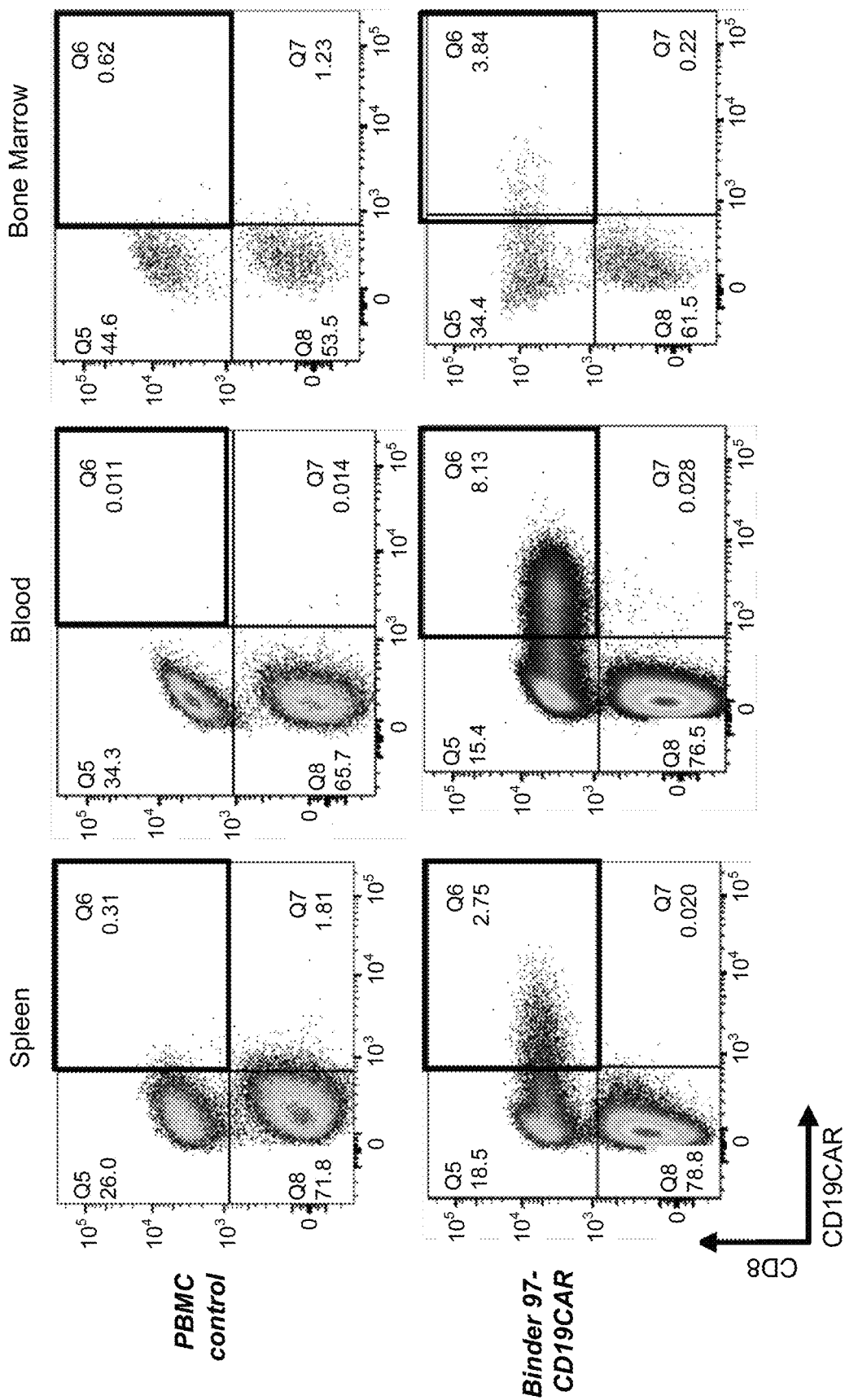

As shown in FIG. 11A, CD8-CD19CAR LV and activated hPBMC treatment resulted in robust control of Nalm6 tumor growth over time. As shown in FIG. 11B, high dose CD8-CD19CAR LV and non-activated hPBMC treatment resulted in slightly delayed yet robust control of Nalm6 tumor growth. FIG. 11C shows the percent of on-target CD19CAR expressing cells (CD8+CD19CAR+) in total recovered live lymphocytes as indicated in top right quandrant of the FACs plots in both PBMC control (top plots) and CD8 fusosome-treated animals (bottom plots). There was no statistical difference in the frequency of CAR-T cells in the bone marrow of animals that received 5 E7 IU of CD8-CD19CAR LV, either with or without hPBMC activation. The results indicate that CD19-specific CAR T cells could be detected in CD8+ T cells up to 28 days post-treatment in the peripheral blood, spleen and bone marrow.

Example 4: A 5 and 7-Week Single Dose Pharmacokinetic and Pharmacodynamic Study of CD8-SFFV-CD20CAR by Intravenous Infusion in Juvenile Female Nemestrina Macaques This Example describes a lentiviral vector pseudotyped with an anti-CD8 binding protein (binder 46) targeting CD8+ T cells to deliver a CD20 CAR transgene (CD8-SFFV-CD20CAR). The CD20CAR contained an anti-scFv directed against CD20 and an intracellular signaling domain containing intracellular components of 4-1 BB and CD3-zeta. The objective of this study was to characterize the ability of CD8-SFFV-CD20CAR to transduce T cells and deplete normal, healthy CD20+ B cells, the biodistribution of viral integration, and tolerability of intravenous administration. Eight juvenile female nemestrina macaques were administered CD8-SFFV-CD20CAR at a single maximum feasible dose of 7.69E8 IU/kg (n=6) or saline control at 10 ml/kg (n=2) intravenously over 1 hour. Animals were evaluated at baseline (Day −35, −28 and −21) for frequency of B and T-cells together with an assessment of hematological and clinical chemistry parameters. On-study animals were monitored daily for clinical observations, weekly for changes in body weight, temperature, neurological battery, and hematology and clinical chemistry. CSF samples were collected pre-study, on Day 7 and at termination (from days 35-52). All animals underwent routine blood sampling and flow cytometry immune-phenotyping for changes in B and T-cell frequencies on Day 3, 5, 7, 10, 14, 17, 21, 28, and 35. At termination, animals underwent a full necropsy, blood, CSF, and tissues were harvested for: flow cytometry of lymphoid tissues, cytokine analyses by Luminex, transgene expression by PCR, vector copy number (VCN) by ddPCR, insertion site distribution (ISD) by deep sequencing, clinical pathology (hematology and clinical chemistry), tissue immunohistochemistry, and anatomic histopathology.

Figure 12:
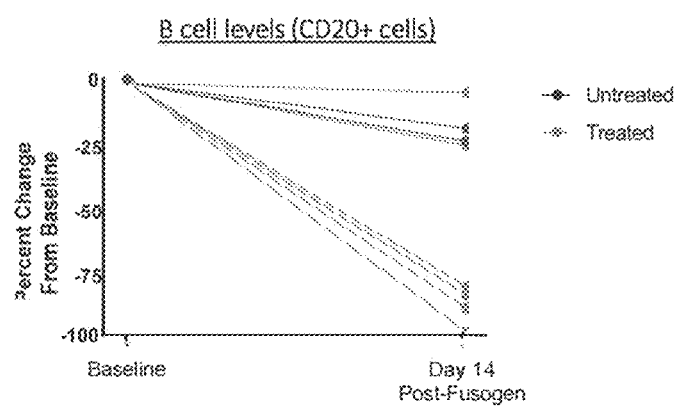
Figure 13:
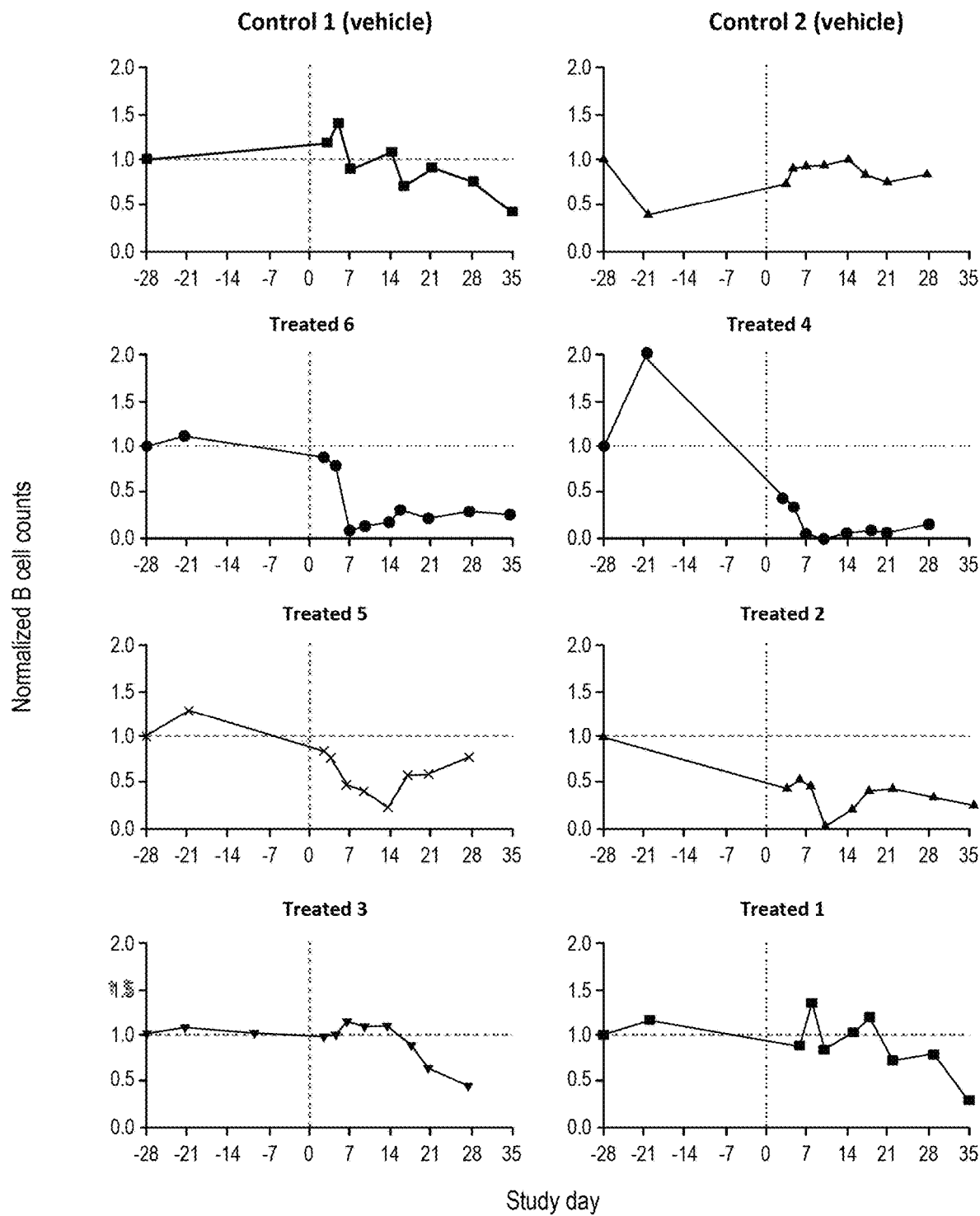

Interim data to Day 35 demonstrated that administration CD8-SFFV-CD20CAR at a single maximum feasible dose of 7.69E8 IU/kg was well-tolerated in all animals. There were no compound-related changes in clinical observations including neurological signs, body temperature nor clinical chemistry values across all sampling times. There were transient minimal reductions of platelets and neutrophils on Day 7-10 that returned to baseline by Day 14. There were transient, minimal decreases in hematocrit and associated increase in reticulocyte counts in two animals, which may be attributed to repeated blood sampling. As shown in FIG. 12, flow cytometric analyses demonstrated a significant decrease in CD20+ B cells in 4 of 6 treated animals beginning on Day 7 in peripheral blood compared to intra-animal pre-dosing, that was sustained through Day 35. Normalized B cell counts through day 28/35 are presented in FIG. 13. These data are consistent with the anticipated pharmacological activity of the anti-CD20CAR.

Preliminary VCN measurements using ddPCR were performed on samples from 2 control and 4 treated animals from Day −35 and Day 14 and 35 in peripheral blood mononuclear cells (PBMC's), and at termination in spleen and bone marrow. At Day −35, and 35 post-injection, VCN in PBMC's was observed though the values were below limit of quantitation (BLQ) in all animals. By comparison in the spleen VCN was detected in treated animals whereas control animals were BLQ. At Day 35, 0.04 to 1.3% of splenocytes (ie. 67 to 1,970 cells) contained at least one inserted copy in CD8-SFFV-CD20CAR treated animals examined. CD20 CAR mRNA was also detected in the spleen of the treated monkeys but not in the control animals.

Additional VCN measurements of transgene integration in the genome was measured via droplet digital polymerase chain reaction (ddPCR) using the WPRE (Woodchuck hepatitis virus Post-transcriptional Response Element) amplicon. Transgene was quantifiable or detectable in PBMCs of all (6 of 6) fusosome-dosed animals collected on study days 3 through 9/10 (Table 17), and detectable on days 14 through days 27/28 in PBMC samples in Animals 1, 4, and 6.

TABLE 17

Transgene integration measured by vector copy number (VCN) for PBMC samples collected in-life.

| Animal | Day −28 | Day 3 | Day 5 | Day 7 | Days 9/10 | Day 14 | Days 16-18 | Day 21 | Days 27/28 | Day 35 |
|---|---|---|---|---|---|---|---|---|---|---|
| Control 1 | U | U | U | U | U | U | U | U | U | U |
| Control 2 | U | U | U | U | U | No sample | U | U | U | U |

TABLE 17-continued

Transgene integration measured by vector copy number (VCN) for PBMC samples collected in-life.

| Animal | Day −28 | Day 3 | Day 5 | Day 7 | Days 9/10 | Day 14 | Days 16-18 | Day 21 | Days 27/28 | Day 35 |
|---|---|---|---|---|---|---|---|---|---|---|
| 1 | U | 0.00342 | 0.00273 | D | 0.00220 | U | D | D | D | U |
| 2 | U | D | D | 0.00207 | 0.00263 | U | U | U | U | U |
| 3 | U | D | D | D | 0.00283 | U | U | U | U | U |
| 4 | U | 0.00331 | D | 0.00326 | 0.00230 | D | D | U | U | U |
| 5 | U | 0.00254 | 0.00179 | 0.00289 | 0.00131 | U | U | U | U | U |
| 6 | U | 0.00820 | 0.00718 | No Sample | No Sample | U | D | D | U | U |

Vector copy number (VCN) was only reported when WPRE copies were in range of quantitation (50 to 120,000 copies per reaction). VCN was calculated as WPRE copies ×2/TERT and reported as VCN (integrations per diploid genome). If WPRE VCN copies were below LLOQ (Lower limit of quantification of < 50 copies per reaction) but above LLOD (Lower limit of detection of < 10 copies per reaction) WPRE VCN was reported as detectable. If WPRE copies were below WPRE VCN was reported undetectable.
D, detectable;
U, undetectable.

These data demonstrate on-target activity of CD8-SFFV-CD20CAR in immune competent animals that was well tolerated and was correlated with presence of vector in cells in the spleen, even in the absence of administration of T-cell activating treatment.

TABLE 5

VH Sequences

| CD8 Binder | VH Sequence | SEQ ID NO: |
|---|---|---|
| 1 | QVQLVQSGAEVKKPGASVKVSCKASGGTFSSYAISWVRQAPGQGLEWMGIIDPSDGNTNYA-QNFQGRVTMTRDTSTSTVYMELSSLRSEDTAVYYCAKERAAAGYYYYMDVWGQGTTVTVSS | 405 |
| 2 | QVQLVQSGAEVKKPGASVKVSCKASGGTFNTYAINWVRQAPGQGLEWMGRIDPSSGGTKYA-QNFQGRVTMTRDTSTSTVYMELSSLRSEDTAVYYCAKEHAAGTYYYYMDVWGKGTTVTVSS | 406 |
| 3 | QVQLVQSGAEVKKPGASVKVSCKASGGTFSSYAINWVRQAPGQGLEWMGIIDPSGGNTNYA-QNFQGRVTMTRDTSTSTVYMELSSLRSEDTAVYYCAKERAAAGYYYYMDVWGQGTTVTVSS | 407 |
| 4 | QVQLVQSGAEVKKPGASVKVSCKASGYTFTGYYMHWVRQAPGQGLEWMGHINPNNGDTNYA-QNFQGRVTMTRDTSTSTVYMELSSLRSEDTAVYYCAKEGYYYYGMDVWGQGTTVTVSS | 651 |
| 5 | QVQLVQSGAEVKKPGASVKVSCKASGYTFTDYYIQWVRQAPGQGLEWMGWINPNSGGTSYA-QKFQGRVTMTRDTSTSTVYMELSSLRSEDTAVYYCAKEGDYYYGMDAWGQGTMVTVSS | 408 |
| 6 | QVQLVQSGAEVKKPGASVKVSCKASGYTFTRYDIHWVRQAPGQGLEWMGVINPNDGSTRYA-QNFQGRVTMTRDTSTSTVYMELSSLRSEDTAVYYCARERGGMPDYWGQGTLVTVSS | 409 |
| 7 | QVQLVQSGAEVKKPGASVKVSCKASGYTFTSYAMNWVRQAPGQGLEWMGRINPNSGGTNYA-QKFQGRVTMTRDTSTSTVYMELSSLRSEDTAVYYCARGHGIPKYWGQGTLVTVSS | 410 |
| 8 | QVQLVQSGAEVKKPGASVKVSCKASGYTFTSYYIHWVRQAPGQGLEWMGWMNPNSGNTGYA-QKFQGRVTMTRDTSTSTVYMELSSLRSEDTAVYYCARVRSGSPQHWGQGTLVTVSS | 411 |
| 9 | QVQLVQSGAEVKKPGASVKVSCKASGHTFSRHYIHWVRQAPGQGLEWMGWMNPNSGNTGYA-QKFQGRVTMTRDTSTSTVYMELSSLRSEDTAVYYCARGGPWIVDAFDIWGQGTMVTVSS | 412 |
| 10 | QVQLVQSGAEVKKPGASVKVSCKASGYTFTSYGISWVRQAPGQGLEWMGWISAHNGVTQYA-QKFQGRVTMTRDTSTSTVYMELSSLRSEDTAVYYCARGIAVAGTDYWGQGTLVTVSS | 652 |
| 11 | QVQLVQSGAEVKKPGASVKVSCKASGGTFSNTDINWVRQAPGQGLEWMGIINPSGGSTSYA-QKFQGRVTMTRDTSTSTVYMELSSLRSEDTAVYYCAREATWGPYYYYMDVWGKGTTVTVSS | 413 |
| 12 | QVQLVQSGAEVKKPGASVKVSCKASGYTFTRSYVHWVRQAPGQGLEWMGWISPYNGNTKYA-QKFQGRVTMTRDTSTSTVYMELSSLRSEDTAVYYCVRNKDGLQHWGQGTLVTVSS | 414 |
| 13 | QVQLVQSGAEVKKPGASVKVSCKASGDTFTGYYMHWVRQAPGQGLEWMGI-INPNSGDTKYAHQFQGRVTMTRDTSTSTVYMELSSLRSEDTAVYYCAKDAKRVGYYYYMDVWGKGTTVTVSS | 415 |
| 14 | QVQLVQSGAEVKKPGASVKVSCKASGYTFTRYYMHWVRQAPGQGLEWMGRINPNSGGTNYA-QKFQGRVTMTRDTSTSTVYMELSSLRSEDTAVYYCARLVGGSPDYWGQGTLVTVSS | 416 |
| IS | QVQLVQSGAEVKKPGASVKVSCKASGYTFTNYDINWVRQAPGQGLEW-MGRINPNSGGTNYAENFQGRVTMTRDTSTSTVYMELSSLRSEDTAVYYCARGAMVDYWGQGTLVTVSS | 417 |
| 16 | QVQLVQSGAEVKKPGASVKVSCKASGGTFSNTDINWVRQAPGQGLEWMGIINPSDGDTKYA-QEFQGRVTMTRDTSTSTVYMELSSLRSEDTAVYYCARGNYVGSYYYGMDVWGQGTTVTVSS | 418 |
| 17 | QVQLVQSGAEVKKPGASVKVSCKASGYTFTNYYLHWVRQAPGQGLEWMGWINPNSGDTKYA-QKFQGRVTMTRDTSTSTVYMELSSLRSEDTAVYYCARDSRGDWYFDLWGRGTLVTVSS | 419 |

TABLE 5-continued

| CD8 Binder | VH Sequence | SEQ ID NO: |
|---|---|---|
| 18 | QVQLVQSGAEVKKPGASVKVSCKASGYGFT RYSIHWVRQAPGQGLEWMGVIDPSGGSTSY A-QKFQGRVTMTRDTSTSTVYMELSSLRSE DTAVYYCTRHGGRGLADYWGQGTLVTVSS | 420 |
| 19 | QVQLVQSGAEVKKPGASVKVSCKASGYTFT SRDISWVRQAPGQGLEWMGWIDPKSGDTTY A-QKFQGRVTMTRDTSTSTVYMELSSLRSE DTAVYYCARLKELSSILDAFDIWGQGTMVT VSS | 421 |
| 20 | QVQLVQSGAEVKKPGASVKVSCKASGYTFT SYDINWVRQAPGQGLEWMGMINPGAGSSTY A-QKFQGRVTMTRDTSTSTVYMELSSLRSE DTAVYYCARERFGTGYYYYMDVWGQGTMVT VSS | 422 |
| 21 | EVQLLESGGGLVQPGGSLRLSCAASGFTFS NSDMNWVRQAPGKGLEWVSLISGDGGTTY- YADSVKGRFTISRDNSKNTLYLQMNSLRAE DTAVYYCARVIGEMVDDAFDLWGQGTTVTV SS | 423 |
| 22 | QVQLVQSGAEVKKPGASVKVSCKASGYTFT GYYMHWVRQAPGQGLEWMGSINPNSGDTGY A-QKFQGRVTMTRDTSTSTVYMELSSLRSE DTAVYYCARERLFGTYYYYMDVWGKGTTVT VSS | 424 |
| 23 | QVQLVQSGAEVKKPGSSVKVSCKASGYTFT TYDINWVRQAPGQGLEWMGRIIPIFGTANY A-QKFQGRVTITADESTSTAYMELSSLRSE DTAVYYCARADGELTDYWGQGTLVTVSS | 425 |
| 24 | EVQLLESGGGLVQPGGSLRLSCAASGFTFS SYTMDWVRQAPGKGLEWVSAIGTGGGIY-Y ADSVKGRFTISRDNSKNTLYLQMNSLRAED TAVYYCARHHLPAHYYYYMDVWGKGTTVTV SS | 426 |
| 25 | QVQLVQSGAEVKKPGASVKVSCKASGGTFS RYDINWVRQAPGQGLEWMGRINPNSGDTNY A-QKFQGRVTMTRDTSTSTVYMELSSLRSE DTAVYYCARDVPAGRYYYYMDVWGKGTLVT VSS | 427 |
| 26 | QVQLVQSGAEVKKPGASVKVSCKASGNTFT SYYMHWVRQAPGQGLEWMGMINPSDGSTRY A-QKFQGRVTMTRDTSTSTVYMELSSLRSE DTAVYYCAKDRGVGRYYYYMDVWGKGTTVT VSS | 428 |
| 27 | QVQLVQSGAEVKKPGASVKVSCKASGGTFS RYAVSWVRQAPGQGLEWMGIINPSDGSTTY A-QKFQGRVTMTRDTSTSTVYMELSSLRSE DTAVYYCAKDSRYGRYYYYMDVWGKGTTVT VSS | 429 |
| 28 | QVQLVQSGAEVKKPGSSVKVSCKASGGTFS NYAISWVRQAPGQGLEWMGIINPNGGSPSY A-QKFQGRVTITADESTSTAYMELSSLRSE DTAVYYCAKEIVVGPYYYYMDVWGKGTTVT VSS | 430 |
| 29 | QVQLVQSGAEVKKPGSSVKVSCKASGGTFT RYAISWVRQAPGQGLEWMGRINPSGDTNY A-QKFQGRVTITADESTSTAYMELSSLRSE DTAVYYCARGMVRGPYYYYMDVWGKGTTVT VSS | 431 |
| 30 | QVQLVQSGAEVKKPGSSVKVSCKASGGTFS SYAISWVRQAPGQGLEWMGI-INPSGGSTS YAQTFQGRVTITADESTSTAYMELSSLRSE DTAVYYCAREGVTGPYYYYMDVWGQGTTVT VSS | 432 |
| 31 | QVQLVQSGAEVKKPGASVKVSCKASGGTFS RFDINWVRQAPGQGLEWMGIINPSDGSTDY A-QNFQGRVTMTRDTSTSTVYMELSSLRSE DTAVYYCARDAAAGTRYYYYYGMDVWGQGT TVTVSS | 433 |
| 32 | QVQLVQSGAEVKKPGASVKVSCKASGGTFS SHAISWVRQAPGQGLEWMGIINPSGGSTSY A-QKFQGRVTMTRDTSTSTVYMELSSLRSE DTAVYYCARELYSSTYYYYMDVWGKGTTVT VSS | 434 |
| 33 | QVQLVQSGAEVKKPGASVKVSCKASGGTFS SYAISWVRQAPGQGLEW-MGRINPNTGGTN HAQKFQGRVTMTRDTSTSTVYMELSSLRSE DTAVYYCARALYSGPYYYYMDVWGKGTTVT VSS | 435 |
| 34 | EVQLLESGGGLVQPGGSLRLSCAASGFTFS NSDMNWVRQAPGKGLEWVSAISGSGGSTY- YADSVKGRFTISRDNSKNTLYLQMNSLRAE DTAVYYCAKEHAAGTYYYYMDVWGKGTTVT VSS | 436 |
| 35 | QVQLVQSGAEVKKPGASVKVSCKASGGTFG SYGINWVRQAPGQGLEWMGWIS-GYNGDTD YARKLQGRVTMTRDTSTSTVYMELSSLRSE DTAVYYCARDSLVGRYYYYMDVWGKGTTVT VSS | 437 |
| 36 | QVQLVQSGAEVKKPGASVKVSCKASGYIFT DYDIYWVRQAPGQGLEWL-GWISADNGNTN YEQKVQGRVTMTRDTSTSTVYMELSSLRSE DTAVYYCARRSELDYWGQGTLVTVSS | 438 |
| 37 | QVQLVQSGAEVKKPGASVKVSCKASGYTFT SYHMHWVRQAPGQGLEWMGWISPNSGATH- YAQKFQGRVTMTRDTSTSTVYMELSSLRSE DTAVYYCARGDDNDYWGQGTLVTVSS | 439 |
| 38 | QVQLVQSGAEVKKPGASVKVSCKASGYTFT SYDINWVRQAPGQGLEW-MGWINPNSGNTG YAKKFQGRVTMTRDTSTSTVYMELSSLRSE DTAVYYCARGEEVDYWGQGTLVTVSS | 440 |
| 39 | QVQLVQSGAEVKKPGASVKVSCKASGYTFT SYPMNWVRQAPGQGLEWMGIINPSGGSTRY A-QKFQGRVTMTRDTSTSTVYMELSSLRSE DTAVYYCARGRRVPDYWGQGTLVTVSS | 441 |
| 40 | QVQLVQSGAEVKKPGASVKVSCKASGYTFT DYYIHWVRQAPGQGLEWMGWINPKSGATNY A-QKFQGRVTMTRDTSTSTVYMELSSLRSE DTAVYYCARGKVTTDYWGQGTLVTVSS | 442 |
| 41 | EVQLLESGGGLVQPGGSLRLSCAASGFTFS SFEMNWVRQAPGKGLEWVSRISESGDSS-F YADSVKGRFTISRDNSKNTLYLQMNSLRAE DTAVYYCASGRELIEYWGQGTLVTVSS | 443 |
| 42 | EVQLLESGGGLVQPGGSLRLSCAASGFTFD DYAMHWVRQAPGKGLEWVSAIGTGGGTY-Y ADSVKGRFTISRDNSKNTLYLQMNSLRAED TAVYYCARVYDFPDVWGQGTTVTVSS | 444 |

TABLE 6

| CD8 Binder | VL Sequence | SEQ ID NO: |
|---|---|---|
| 1 | DIQMTQSPSSLSASVGDRVTITCRASQSISSYLNWYQQKPGKAPKLLIYAAS-SLQSGVPSRFSGSGSGTDFTLTISSLQPEDFATYYCQQSYSTPLTFGGGTKVEIKR | 499 |
| 2 | DIQMTQSPSSLSASVGDRVTITCQASQDISNYLNWYQQKPGKAPKLLIYAAS-SLQSGVPSRFSGSGSGTDFTLTISSLQPEDFATYYCQQSYSNLVSFGQGTKVEIKR | 500 |
| 3 | DIQMTQSPSSLSASVGDRVTITCRASQSISSYLNWYQQKPGKAPKLLIYAAS-SLQSGVPSRFSGSGSGTDFTLTISSLQPEDFATYYCQQSYSTPLTFGQGTKVEIKR | 501 |
| 4 | DIVMTQSPLSLPVTPGEPASISCRSSQSLLHSNGYNYLDWYLQKPGQSPQLLIYL-GSNRASGVPDRFSGSGSGTDFTLKISRVEAEDVGVYYCMQALQTPFTFGPGTKVDIKR | 502 |
| 5 | DIVMTQSPLSLPVTPGEPASISCRSSQSLLHSNGYNYLDWYLQKPGQSPQLLIYL-GSNRASGVPDRFSGSGSGTDFTLKISRVEAEDVGVYYCMQGLQTPHTFGQGTKVEIKR | 503 |
| 6 | DIQMTQSPSSLSASVGDRVTITCRASQSISRNLNWYQQKPGKAPKLLI-YKASNLKGGVPSRFSGSGSGTDFTLTISSLQPEDFATYYCQQTYSAPLFGQGTKLEIKR | 504 |
| 7 | DIVMTQSPLSLPVTPGEPASISCRSSQSLLHSNGYNYLDWYLQKPGQSPQLLIYL-GSNRASGVPDRFSGSGSGTDFTLKISRVEAEDVGVYYCMQTLQTPLTFGQGTKVEIKR | 505 |
| 8 | EIVMTQSPATLSVSPGERATLSCRASQSVSASDLAWYQQKPGQAPRLLIYGASTRAT-GIPARFSGSGSGTEFTLTISSLQSEDFAVYYCQQYGDSPGSFGQGTKLEIKR | 506 |
| 9 | DIQMTQSPSSLSASVGDRVTITCQASQDIGNYLNWYQQKPGKAPKLLI-YAASTLQRGVPSRFSGSGSGTDFTLTISSLQPEDFATYYCQQANSFPPTFGGGTKVEIKR | 507 |
| 10 | EIVMTQSPATLSVSPGERATLSCRASQSISTHLAWYQQKPGQAPRLLIYGASTRAT-GIPARFSGSGSGTEFTLTISSLQSEDFAVYYCQQYGNSRTFGQGTKVEIKR | 508 |
| 11 | DIQMTQSPSSLSASVGDRVTITCRASQTISNYLNWYQQKPGKAPKLLI-YAASTLQSGVPSRFSGSGSGTDFTLTISSLQPEDFATYYCQQSYSTPPTFGQGTKLEIKR | 509 |
| 12 | DIQMTQSPSSLSASVGDRVTITCRASQGIRNDLGWYQQKPGKAPKLLI-YDASTLQSGVPSRFSGSGSGTDFTLTISSLQPEDFATYYCQQSYSSPYTFGQGTKLEIKR | 510 |
| 13 | DIQMTQSPSSLSASVGDRVTITCRASQSISNYLNWYQQKPGKAPKLLIYAAS-SLQSGVPSRFSGSGSGTDFTLTISSLQPEDFATYYCQQSYSTPYTFGQGTKLEIKR | 511 |
| 14 | DIVMTQSPLSLPVTPGEPASISCRSSQSLLHSNGYNYLDWYLQKPGQSPQLLIYL-GSNRASGVPDRFSGSGSGTDFTLKISRVEAEDVGVYYCMQGAHWPPTFGQGTKLEIKR | 512 |
| 15 | DIQMTQSPSSLSASVGDRVTITCRASQGISDSLAWYQQKPGKAPKLLI-YGASSLRSGVPSRFSGSGSGTDFTLTISSLQPEDFATYYCQQSYRTPYTFGQGTKLEIKR | 513 |
| 16 | DIQMTQSPSSLSASVGDRVTITCRASQSISNYLNWYQQKPGKAPKLLIYAAS-SLQSGVPSRFSGSGSGTDFTLTISSLQPEDFATYYCQESFTTQWTFGQGTKVEIKR | 514 |
| 17 | DIQMTQSPSSLSASVGDRVTITCQASQDIHNYLNWYQQKPGKAPKLLIYDASN-LETGVPSRFSGSGSGTDFTLTISSLQPEDFATYYCQQANSFPPTFGPGTKVDIKR | 515 |
| 18 | DIQMTQSPSSLSASVGDRVTITCQASQDISNYLNWYQQKPGKAP-KLLIYSASSLQSGVPSRFSGSGSGTDFTLTISSLQPEDFATYYCQQRSNWPLYTFGQGTKVEIKR | 516 |
| 19 | DIQMTQSPSSLSASVGDRVTITCRASQSISDWLAWYQQKPGKAPKLLIYAAS-SLQTGVPSRFSGSGSGTDFTLTISSLQPEDFATYYCQQAISFPITFGQGTKVEIKR | 517 |
| 20 | DIQMTQSPSSLSASVGDRVTITCQASQDISNYLNWYQQKPGKAP-KLLIYSASTLQSGVPSRFSGSGSGTDFTLTISSLQPEDFATYYCQQSYSSPFTFGPGTKVDIKR | 518 |
| 21 | DIQMTQSPSSLSASVGDRVTITCRASQSISTWLAWYQQKPGKAPKLLI-YAASTLQSGVPSRFSGSGSGTDFTLTISSLQPEDFATYYCQQAISFPLTFGGGTKVEIKR | 519 |
| 22 | DIQMTQSPSSLSASVGDRVTITCRASQSISNYLNWYQQKPGKAPKLLI-YAASTLQSGVPSRFSGSGSGTDFTLTISSLQPEDFATYYCQQSYTFPITFGQGTRLEIKR | 520 |
| 23 | DIVMTQSPLSLPVTPGEPASISCRSSQSLLHSNGYNYLDWYLQKPGQSPQLLIYDASH-LETGVPDRFSGSGSGTDFTLKISRVEAEDVGVYYCQQYYSYPPTFGQGTKVEIKR | 521 |
| 24 | DIQMTQSPSSLSASVGDRVTITCQASQDISNYLNWYQQKPGKAPKLLI-YAASTLHSGVPSRFSGSGSGTDFTLTISSLQPEDFATYYCQQSYSAPLTFGPGTKVDIKR | 522 |

TABLE 6-continued

VL Sequences

| CD8 Binder | VL Sequence | SEQ ID NO: |
|---|---|---|
| 25 | DIQMTQSPSSLSASVGDRVTITCQASQDISNYLNWYQQKPGKAPKLLIYAASTLQSGVPSRFSGSGSGTDFTLTISSLQPEDFATYYCQQSFSTFYTFGQGTKVEIKR | 523 |
| 26 | DIQMTQSPSSLSASVGDRVTITCQASQDISNYLNWYQQKPGKAPKLLIYAASTLQSGVPSRFSGSGSGTDFTLTISSLQPEDFATYYCQQSYSIPFTFGPGTKVDIKR | 524 |
| 27 | DIQMTQSPSSLSASVGDRVTITCRASQSINRFLNWYQQKPGKAPKLLIYAASSLQNGVPSRFSGSGSGTDFTLTISSLQPEDFATYYCQQSYSTPYTFGQGTKVEIKR | 525 |
| 28 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR | 499 |
| 29 | DIQMTQSPSSLSASVGDRVTITCQASQDISNYLNWYQQKPGKAPKLLIYAASTLQSGVPSRFSGSGSGTDFTLTISSLQPEDFATYYCQQSYSTPITFGQGTRLEIKR | 526 |
| 30 | DIQMTQSPSSLSASVGDRVTITCRASQSVSTYLNWYQQKPGKAPKLLIYAASSLQSGVPSRFSGSGSGTDFTLTISSLQPEDFATYYCQQSYTIPSTFGQGTKVEIKR | 527 |
| 31 | DIQMTQSPSSLSASVGDRVTITCQASQDIAKYLNWYQQKPGKAPKLLIYAASSLQSGVPSRFSGSGSGTDFTLTISSLQPEDFATYYCQQSYSAPPTFGGGTKVEIKR | 528 |
| 32 | DIQMTQSPSSLSASVGDRVTITCQASQGITNYLNWYQQKPGKAPKLLIYGASSLQSGVPSRFSGSGSGTDFTLTISSLQPEDFATYYCQQSYSTPWTFGPGTKVDIKR | 529 |
| 33 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR | 499 |
| 34 | DIQMTQSPSSLSASVGDRVTITCQASQDIHNYLNWYQQKPGKAPKLLIYAASTLQSGVPSRFSGSGSGTDFTLTISSLQPEDFATYYCQQSYTTPLTFGQGTKVEIKR | 530 |
| 35 | DIQMTQSPSSLSASVGDRVTITCQASQDISNYLNWYQQKPGKAPKLLIYSAFSLQSGVPSRFSGSGSGTDFTLTISSLQPEDFATYYCQQSYSAPITFGQGTRLEIKR | 531 |
| 36 | DIQMTQSPSSLSASVGDRVTITCRASQSISSYLNWYQQKPGKAPKLLIYSASNLQSGVPSRFSGSGSGTDFTLTISSLQPEDFATYYCQQRSNWPPVTFGQGTKVEIKR | 532 |
| 37 | DIQMTQSPSSLSASVGDRVTITCQANQDISNFLEWYQQKPGKAPKLLIYDASSLESGVPSRFSGSGSGTDFTLTISSLQPEDFATYYCQQSYSIPITFGQGTRLEIKR | 533 |
| 38 | DIQMTQSPSSLSASVGDRVTITCRASQGISNNLNWYQQKPGKAPKLLIYEASTLESGVPSRFSGSGSGTDFTLTISSLQPEDFATYYCQQSYSTPLTFGGGTKVEIKR | 534 |
| 39 | DIVMTQSPLSLPVTPGEPASISCRSSQSLLHSNGYNYLDWYLQKPGQSPQLLIYGASTLETGVPDRFSGSGSGTDFTLKISRVEAEDVGVYYCMQGLQPPGTFGQGTKVEIKR | 535 |
| 40 | DIQMTQSPSSLSASVGDRVTITCRASQSISRSLVWYQQKPGKAPKLLIYAASTLQTGVPSRFSGSGSGTDFTLTISSLQPEDFATYYCQQSYNHFRTFGPGTKVDIKR | 536 |
| 41 | DIQMTQSPSSLSASVGDRVTITCQASQDISNYLNWYQQKPGKAPKLLIYDASNLETGVPSRFSGSGSGTDFTLTISSLQPEDFATYYCQRSDSTPLTFGGGTKVEIKR | 537 |
| 42 | DIQMTQSPSSLSASVGDRVTITCQASHDISKSLNWYQQKPGKAPKLLIYGASTLQSGVPSRFSGSGSGTDFTLTISSLQPEDFATYYCQQLNSYPRTFGGGTKVEIKR | 538 |
| 43 | DIQMTQSPSSLSASVGDRVTITCRASQDIGAYLAWYQQKPGKAPKLLIYAASSLQSGVPSRFSGSGSGTDFTLTISSLQPEDFATYYCQQSYSIPYTFGQGTKLEIKR | 539 |
| 44 | DIQMTQSPSSLSASVGDRVTITCRASQSISSYLAWYQQKPGKAPKLLIYAASSLQSGVPSRFSGSGSGTDFTLTISSLQPEDFATYYCQQSYSTPYTFGQGTKLEIKR | 540 |
| 45 | DIQMTQSPSSLSASVGDRVTITCRASQGIRSYLAWYQQKPGKAPKLLIYGASNLETGVPSRFSGSGSGTDFTLTISSLQPEDFATYYCQQSYSTPYTFGQGTKLEIKR | 541 |
| 46 | DIQMTQSPSSLSASVGDRVTITCRASQSISSYLNWYQQKPGKAPKLLIYAASSLQSGVPSRFSGSGSGTDFTLTISSLQPEDFATYYCQQTYSTPYTFGQGTKLEIKR | 542 |
| 47 | DIQMTQSPSSLSASVGDRVTITCRASQNIGTWLAWYQQKPGKAPKLLIYAASTLQSGVPSRFSGSGSGTDFTLTISSLQPEDFATYYCQQSYSTPQTFGPGTKVDIKR | 543 |
| 48 | DIQMTQSPSSLSASVGDRVTITCRASQTISYYLNWYQQKPGKAPKLLIYAASTLQSGVPSRFSGSGSGTDFTLTISSLQPEDFATYYCQQSYRTPYTFGQGTKLEIKR | 544 |

TABLE 6-continued

VL Sequences

| CD8 Binder | VL Sequence | SEQ ID NO: |
|---|---|---|
| 49 | DIVMTQSPLSLPVTPGEPASISCRSSQSLLHSNGYNYLDWYLQKPGQSPQLLIYMGSNRASGVPDRFSGSGSGTDFTLKISRVEAEDVGVYYCMQGTHWPTFGQGTRLEIKR | 545 |
| 50 | DIQMTQSPSSLSASVGDRVTITCRASQNINNYLNWYQQKPGKAPKLLIYGASSLQSGVPSRFSGSGSGTDFTLTISSLQPEDFATYYCQQTFSLPYTFGQGTKVEIKR | 546 |
| 51 | DIQMTQSPSSLSASVGDRVTITCRASQTISTYLNWYQQKPGKAPKLLIYDASNLETGVPSRFSGSGSGTDFTLTISSLQPEDFATYYCQQSYSTPYTFGQGTKLEIKR | 547 |
| 52 | DIQMTQSPSSLSASVGDRVTITCRASRGIGNDLAWYQQKPGKAPKLLIYDASTLETGVPSRFSGSGSGTDFTLTISSLQPEDFATYYCQQGYNIVIPLTFGGGTKVEIKR | 548 |
| 52 | DIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGGGTKVEIKR | 549 |
| 54 | DIQMTQSPSSLSASVGDRVTITCRASQFIGSWLAWYQQKPGKAPKLLIYAASTLQSGVPSRFSGSGSGTDFTLTISSLQPEDFATYYCQQSYSFPWTFGQGTKVEIKR | 550 |
| 55 | DIQMTQSPSSLSASVGDRVTITCRASQSISSWMAWYQQKPGKAPKLLIYDASNLETGVPSRFSGSGSGTDFTLTISSLQPEDFATYYCQQTYSTPYIFGQGTKVEIKR | 551 |
| 56 | DIQMTQSPSSLSASVGDRVTITCRASQGISNNLNWYQQKPGKAPKLLIYDASNLETGVPSRFSGSGSGTDFTLTISSLQPEDFATYYCQQSYSSPWTFGQGTKVEIKR | 552 |
| 57 | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYASAPRTFGQGTKLEIKR | 553 |
| 58 | DIQMTQSPSSLSASVGDRVTITCRASQSISSYLNWYQQKPGKAPKLLIYKTSSLESGVPSRFSGSGSGTDFTLTISSLQPEDFATYYCQQSFTIPYTFGQGTKVEIKR | 554 |
| 59 | DIQMTQSPSSLSASVGDRVTITCRVSQGISSYLNWYQQKPGKAPKLLIYGASSLQSGVPSRFSGSGSGTDFTLTISSLQPEDFATYYCQQSYSTPLTFGGGTKVEIKR | 555 |
| 60 | DIQMTQSPSSLSASVGDRVTITCRASQSISDWLAWYQQKPGKAPKLLIYDASNLETGVPSRFSGSGSGTDFTLTISSLQPEDFATYYCQQSYSTPLTFGGGTKVEIKR | 556 |
| 61 | DIQMTQSPSSLSASVGDRVTITCRASQGISNYLAWYQQKPGKAPKLLIYSASNLQSGVPSRFSGSGSGTDFTLTISSLQPEDFATYYCQQTYRTPPTFGPGTKVDIKR | 557 |
| 62 | DIQMTQSPSSLSASVGDRVTITCRASQSIRNYLTWYQQKPGKAPKLLIYSASNLQSGVPSRFSGSGSGTDFTLTISSLQPEDFATYYCQQSYSTPLTFGQGTKVEIKR | 558 |
| 63 | DIQMTQSPSSLSASVGDRVTITCRASQNIRLYLNWYQQKPGKAPKLLIYAASTLQSGVPSRFSGSGSGTDFTLTISSLQPEDFATYYCQQSLTTPFTFGPGTKVDIKR | 559 |
| 64 | DIQMTQSPSSLSASVGDRVTITCQASQDIRKFLNWYQQKPGKAPKLLIYAASSLQSGVPSRFSGSGSGTDFTLTISSLQPEDFATYYCQQLNGYPGTFGQGTRLEIKR | 560 |
| 65 | DIQMTQSPSSLSASVGDRVTITCRASQSISSYLNWYQQKPGKAPKLLIYTASNLQSGVPSRFSGSGSGTDFTLTISSLQPEDFATYYCQQSYSLPLTFGGGTKVEIKR | 561 |
| 66 | DIQMTQSPSSLSASVGDRVTITCQASQDISNYLSWYQQKPGKAPKLLIYDASNLQSGVPSRFSGSGSGTDFTLTISSLQPEDFATYYCQQTYTTPRTFGPGTKVDIKR | 562 |
| 67 | DIQMTQSPSSLSASVGDRVTITCRASQNVRSWLAWYQQKPGKAPKLLIYAASSLQSGVPSRFSGSGSGTDFTLTISSLQPEDFATYYCQQSYNTPYTFGQGTKLEIKR | 563 |
| 68 | DIQMTQSPSSLSASVGDRVTITCRASQGIGNDLGWYQQKPGKAPKLLIYAASSLQSGVPSRFSGSGSGTDFTLTISSLQPEDFATYYCQQSYAPPPTFGQGTKVEIKR | 564 |
| 69 | DIQMTQSPSSLSASVGDRVTITCRASQSISNWLAWYQQKPGKAPKLLIYGASNLETGVPSRFSGSGSGTDFTLTISSLQPEDFATYYCQQSYSTPPTFGQGTKLEIKR | 565 |
| 70 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPLTFGQGTKVEIKR | 566 |
| 71 | DIQMTQSPSSLSASVGDRVTITCRASQSISSYLNWYQQKPGKAPKLLIYLASSLQSGVPSRFSGSGSGTDFTLTISSLQPEDFATYYCQQSDSIPVTFGQGTKVEIKR | 567 |
| 72 | DIQMTQSPSSLSASVGDRVTITCQASQDISNYLNWYQQKPGKAPKLLIYSTSSLQSGVPSRFSGSGSGTDFTLTISSLQPEDFATYYCQQSYSTPYNFGQGTKLEIKR | 568 |

TABLE 6-continued

VL Sequences

| CD8 Binder | VL Sequence | SEQ ID NO: |
|---|---|---|
| 73 | DIQMTQSPSSLSASVGDRVTITCRASE SIGSWLAWYQQKPGKAPKLLIYAAS- SLQSGVPSRFSGSGSGTDFTLTISSLQ PEDFATYYCQQSYSTPYTFGQGTKLEI KR | 569 |
| 74 | DIQMTQSPSSLSASVGDRVTITCRASQ SISNYLNWYQQKPGKAPKLLIYAAS- SLQRGVPSRFSGSGSGTDFTLTISSLQ PEDFATYYCQQSYSTPLTFGQGTKVEI KR | 570 |
| 75 | EIVMTQSPATLSVSPGERATLSCRASQ SVTSNYLAWYQQKPGQAPRLLIYGAST RAT- GIPARFSGSGSGTEFTLTISSLQSEDF AVYYCQHYGSSPAFGQGTRLEIKR | 571 |
| 76 | DIQMTQSPSSLSASVGDRVTITCRASQ SISSYLNWYQQKPGKAPKLLIYAAS- SLQSGVPSRFSGSGSGTDFTLTISSLQ PEDFATYYCQQSYSTPLTFGGGTKVEI KR | 499 |
| 77 | DIQMTQSPSSLSASVGDRVTITCRASQ GISSYLAWYQQKPGKAPKLLI- YAASTLQSGVPSRFSGSGSGTDFTLTI SSLQPEDFATYYCQQSYSTPPTFGPGT KVDIKR | 572 |
| 78 | DIQMTQSPSSLSASVGDRVTITCRASQ DIGNYLNWYQQKPGKAPKLLIYAAS- SLQSGVPSRFSGSGSGTDFTLTISSLQ PEDFATYYCQQAYTYPYTFGQGTKLEI KR | 573 |
| 79 | DIQMTQSPSSLSASVGDRVTITCQASQ DISNYLNWYQQKPGKAPKLLI- YGASSLQSGVPSRFSGSGSGTDFTLTI SSLQPEDFATYYCQQSYTTPNTFGPGT KVDIKR | 574 |
| 80 | DIQMTQSPSSLSASVGDRVTITCRASQ GISNYLAWYQOKPGKAPKLLI- YAASTLQSGVPSRFSGSGSGTDFTLTI SSLQPEDFATYYCQQSYSTPYTFGQGT KVEIKR | 575 |
| 81 | DIQMTQSPSSLSASVGDRVTITCRASQ GISNGLSWYQQKPGKAPKLLIYDASN- LETGVPSRFSGSGSGTDFTLTISSLQP EDFATYYCQQSYSTPFTFGPGTKVDIK R | 576 |
| 82 | DIQMTQSPSSLSASVGDRVTITCRASQ NIRNYLNWYQQKPGKAPKLLI- YGASSLQSGVPSRFSGSGSGTDFTLTI SSLQPEDFATYYCQQSYSTPLTFGGGT KVEIKR | 577 |
| 83 | DIQMTQSPSSLSASVGDRVTITCQASL DINNYLNWYQQKPGKAPKLLI- YKASSLESGVPSRFSGSGSGTDFTLTI SSLQPEDFATYYCQQSYSMPLTFGPGT KVDIKR | 578 |
| 84 | DIQMTQSPSSLSASVGDRVTITCQASQ DISNYLNWYQQKPGKAPKLLIYAAS- SLQGGVPSRFSGSGSGTDFTLTISSLQ PEDFATYYCQQSYTTPWTFGQGTKLEI KR | 579 |
| 85 | DIQMTQSPSSLSASVGDRVTITCQASQ DISNYLNWYQQKPGKAPKLLIYAAS- SLQSGVPSRFSGSGSGTDFTLTISSLQ PEDFATYYCQQSYSSPLTFGGGTKVEI KR | 580 |
| 86 | DIQMTQSPSSLSASVGDRVTITCQASQ DISNYLNWYQQKPGKAPKLLI- YKASSLESGVPSRFSGSGSGTDFTLTI SSLQPEDFATYYCQQSYDPLTFGQGT KVEIKR | 581 |
| 87 | DIQMTQSPSSLSASVGDRVTITCQASQ DISNYLNWYQQKPGKAPKLLI- YGASTLQSGVPSRFSGSGSGTDFTLTI SSLQPEDFATYYCQQSYSAPITFGQGT RLEIKR | 582 |
| 88 | DIQMTQSPSSLSASVGDRVTITCRASQ SISNYLNWYQQKPGKAPKLLI- YAASNLQSGVPSRFSGSGSGTDFTLTI SSLQPEDFATYYCQQSYTTPLTFGPGT KVDIKR | 583 |
| 89 | DIQMTQSPSSLSASVGDRVTITCRASQ NIGNYLNWYQQKPGKAPKLLI- YAASTLQSGVPSRFSGSGSGTDFTLTI SSLQPEDFATYYCQQSYSTPPWTFGQG TKVEIKR | 584 |
| 90 | DIQMTQSPSSLSASVGDRVTITCRASQ DISNYLNWYQQKPGKAPKLLI- YAASTLRSGVPSRFSGSGSGTDFTLTI SSLQPEDFATYYCQQSYQTPLTFGGGT KVEIKR | 585 |
| 91 | DIQMTQSPSSLSASVGDRVTITCRASQ DISNYLNWYQQKPGKAPKLLI- YAASTLQSGVPSRFSGSGSGTDFTLTI SSLQPEDFATYYCQQSYTTPPTFGQGT KVEIKR | 586 |
| 92 | DIQMTQSPSSLSASVGDRVTITCRASQ DISNYLNWYQQKPGKAPKLLIYAAS- SLHSGVPSRFSGSGSGTDFTLTISSLQ PEDFATYYCQQSYSTPQTFGQGTKVEI KR | 587 |
| 93 | DIQMTQSPSSLSASVGDRVTITCRASQ GIRNDLNWYQQKPGKAPKLLI- YAASNLQSGVPSRFSGSGSGTDFTLTI SSLQPEDFATYYCQQANSFPITFGQGT KLEIKR | 588 |
| 94 | DIQMTQSPSSLSASVGDRVTITCRASQ GINTWLAWYQQKPGKAPKLLIYAAS- SLQSGVPSRFSGSGSGTDFTLTISSLQ PEDFATYYCQQSYSTPYTFGQGTRLEI KR | 589 |
| 95 | DIQMTQSPSSLSASVGDRVTITCRASQ DISNYLNWYQQKPGKAPKLLI- YAASTLQSGVPSRFSGSGSGTDFTLTI SSLQPEDFATYYCQQSYTVPPTFGQGT KVEIKR | 590 |
| 96 | DIQMTQSPSSLSASVGDRVTITCQASQ DIRYFLNWYQQKPGKAPKLLI- YAASTLQSGVPSRFSGSGSGTDFTLTI SSLQPEDFATYYCQQDDSFPLTFGGGT KVEIKR | 591 |

TABLE 7

| SEQ ID NO: | SEQUENCE | ANNOTATION |
|---|---|---|
| 592 | MVVILDKRCY CNLLILILMI SECSVGILHY EKLSKIGLVK GVTRKYKIKS NPLTKDIVIK MIPNVSNMSQ CTGSVMENYK TRLNGILTPI KGALEIYKNN THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNTYSRLED RRVRPTSSGD LYYIGT | Nipah virus NiV-F with signal sequence (aa 1-546) Uniprot Q91H63 |
| 593 | ILHY EKLSKIGLVK GVTRKYKIKS NPLTKDIVIK MIP-NVSNMSQ CTGSVMENYK TRLNGILTPI KGALEIYKNN THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNTYSRLED RRVRPTSSGD LYYIGT | Nipah virus NiV-F F0 (aa 27-546) |
| 594 | ILHYEKLSKIGLVKGVTRKYKIKSNPLTKDIVIKMIP-NVSNMSQCTGSVMENYKTRLNGILT-PIKGALEIYKNNTHDLVGDVR | Nipah virus NiV-F F2 (aa 27-109) |
| 595 | LAGVIMAGVAIGIATAAQITAGVALYEAMKNADNINKLKSSI-ESTNEAV-VKLQETAEKTVYVLTALQDYINTNLVPTIDKISCKQTELSLDLA LSKYLSDLLFVFGPNLQDPVSNSMTIQAISQAFGG-NYETLLRTLGYATEDFDDLLESDSITGQIIYVDLSSYYIIVRVY FPILTEIQQAYIQELLPVSFNNDNSEWISIVPN-FILVRNTLISNIEIGFCLITKRSVIC-NQDYATPMTNNMRECLTGSTEKCPRELVVSSHVPRFALSNGVLF ANCISVTCQCQTTGRAISQSGEQTLLMID-nttcptavlgnviislgkylgsvnynsegiaig-PPVFTDKVDISSQISSMNQSLQQSKDYIKEAQRLLDTVNPSLIS MLSMIILYVLSIASLCIGLITFISFII-VEKKRNTYSRLEDRRVRPTSSGDLYYIGT | Nipah virus NiV F F1 (aa 110-546) |
| 596 | ILHY EKLSKIGLVK GVTRKYKIKS NPLTKDIVIK MIP-NVSNMSQ CTGSVMENYK TRLNGILTPI KGALEIYKNN THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNTGT | Nipah virus NiV-F F0 truncation (aa 525-544) |
| 597 | LAGVIMAGVAIGIATAAQITAGVALYEAMKNADNINKLKSSI-ESTNEAV-VKLQETAEKTVYVLTALQDYINTNLVPTIDKISCKQTELSLDLA LSKYLSDLLFVFGPNLQDPVSNSMTIQAISQAFGG-NYETLLRTLGYATEDFDDLLESDSITGQIIYVDLSSYYIIVRVY FPILTEIQQAYIQELLPVSFNNDNSEWISIVPN-FILVRNTLISNIEIGFCLITKRSVIC-NQDYATPMTNNMRECLTGSTEKCPRELVVSSHVPRFALSNGVLF ANCISVTCQCQTTGRAISQSGEQTLLMID-nttcptavlgnviislgkylgsvnynsegiaig-PPVFTDKVDISSQISSMNQSLQQSKDYIKEAQRLLDTVNPSLIS MLSMIILYVLSIASLCIGLITFISFIIVEKKRNTGT | Nipah virus NiV F F1 (aa 110-546) truncation (aa 525-544) |

TABLE 7-continued

| SEQ ID NO: | SEQUENCE | ANNOTATION |
|---|---|---|
| 598 | ILHY EKLSKIGLVK GVTRKYKIKS NPLTKDIVIK MIP-NVSNMSQ CTGSVMENYK TRLNGILTPI KGALEIYKNQ THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNTGT | Nipah virus NiV-F F0 truncation (aa 525-544) AND mutation on N-linked glycosylation site |
| 599 | MVVILDKRCY CNLLILILMI SECSVGILHY EKLSKIGLVK GVTRKYKIKS NPLTKDIVIK MIPNVSNMSQ CTGSVMENYK TRLNGILTPI KGALEIYKNN THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNT | Truncated NiV fusion glycoprotein (FcDelta22) at cytoplasmic tail (with signal sequence) |
| 1092 | ILHY EKLSKIGLVK GVTRKYKIKS NPLTKDIVIK MIPNVSNMSQ CTGSVMENYK TRLNGILTPI KGALEIYKNN THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNT | Truncated NiV fusion glycoprotein (FcDelta22) F0 |
| 1093 | LAGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNT | Truncated NiV fusion glycoprotein (FcDelta22) F1 |
| 600 | MGPAENKKVR FENTTSDKGK IPSKVIKSYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein (602 aa) |
| 601 | MGKVR FENTTSDKGK IPSKVIKSYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN | NiVG protein attachment glycoprotein Truncated A5 |

TABLE 7-continued

| SEQ ID NO: | SEQUENCE | ANNOTATION |
|---|---|---|
| | ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | |
| 602 | MGNTTSDKGK IPSKVIKSYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A10 |
| 603 | MGKGK IPSKVIKSYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A15 |
| 604 | MGSKVIKSYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A20 |
| 605 | MGSYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A25 |

TABLE 7-continued

| SEQ ID NO: | SEQUENCE | ANNOTATION |
|---|---|---|
| 606 | MGTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A30 |
| 607 | MKKINEGLLDSKILSA FNTVIALLGS IVIIVMNIMI IQNY-TRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PAICAEGVYN DAFLIDRINW ISAGVFLDSN ATAANPVFTV FKDNEILYRA QLASEDTNAQ KTITNCFLLK NKIWCISLVE IYDTGDNVIR PKLFAVKIPE QCT | NiVG protein attachment glycoprotein Truncated and mutated (E501A, W504A, Q530A, E533A) NiVG protein (GcA34) |
| 608 | MATQEVRLKC LLCGIIVLVL SLEGLGILHY EKLSKIGLVK GITRKYKIKS NPLTKDIVIK MIPNVSNVSK CTGTVMENYK SRLTGILSPI KGAIELYNNN THDLVGDVKL AGVVMAGIAI GIATAAQITA GVALYEAMKN ADNINKLKSS IESTNEAVVK LQETAEKTVY VLTALQDYIN TNLVPTIDQI SCKQTELALD LALSKYLSDL LFVFGPNLQD PVSNSMTIQA ISQAFGGNYE TLLRTLGYAT EDFDDLLESD SIAGQIVYVD LSSYYIIVRV YFPILTEIQQ AYVQELLPVS FNNDNSEWIS IVPNFVLIRN TLISNIEVKY CLITKKSVIC NQDYATPMTA SVRECLTGST DKCPRELVVS SHVPRFALSG GVLFANCISV TCQCQTTGRA ISQSGEQTLL MIDNTTCTTV VLGNIIISLG KYLGSINYNS ESIAVGPPVY TDKVDISSQI SSMNQSLQQS KDYIKEAQKI LDTVNPSLIS MLSMIILYVL SIAALCIGLI TFISFVIVEK KRGNYSRLDD RQVRPVSNGD LYYIGT | Hendra virus F protein Uniprot O89342 (with signal sequence) |
| 609 | MMADSKLVSL NNNLSGKIKD QGKVIKNYYG TMDIKKINDG LLDSKILGAF NTVIALLGSI IIIVMNIMII QNYTRTTDNQ ALIKESLQSV QQQIKALTDK IGTEIGPKVS LIDTSSTITI PANIGLLGSK ISQSTSSINE NVNDKCKFTL PPLKIHECNI SCPNPLPFRE YRPISQGVSD LVGLPNQICL QKTTSTILKP RLISYTLPIN TREGVCITDP LLAVDNGFFA YSHLEKIGSC TRGIAKQRII GVGEVLDRGD KVPSMFMTNV WTPPNPSTIH HCSSTYHEDF YYTLCAVSHV GDPILNSTSW TESLSLIRLA VRPKSDSGDY NQKYIAITKV ERGKYDKVMP YGPSGIKQGD TLYFPAVGFL PRTEFQYNDS NCPIIHCKYS KAENCRLSMG VNSKSHYILR SGLLKYNLSL GGDIILQFIE IADNRLTIGS PSKIYNSLGQ PVFYQASYSW DTMIKLGDVD TVDPLRVQWR NNSVISRPGQ SQCPRFNVCP EVCWEGTYND AFLIDRLNWV SAGVYLNSNQ TAENPVFAVF KDNEILYQVP LAEDDTNAQK TITDCFLLEN VIWCISLVEI YDTGDSVIRP KLFAVKIPAQ CSES | Hendra virus G protein Uniprot O89343 |
| 610 | MVVILDKRCY CNLLILILMI SECSVGILHY EKLSKIGLVK GVTRKYKIKS NPLTKDIVIK MIPNVSNMSQ CTGSVMENYK | Nipah virus NiV-F F0 truncation (aa 525-544) |

| SEQ ID NO: | SEQUENCE | ANNOTATION |
|---|---|---|
| | TRLNGILTPI KGALEIYKNN THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNTGT | (with signal sequence) |
| 611 | MVVILDKRCY CNLLILILMI SECSVGILHY EKLSKIGLVK GVTRKYKIKS NPLTKDIVIK MIPNVSNMSQ CTGSVMENYK TRLNGILTPI KGALEIYKNQ THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNTGT | Nipah virus NiV-F F0 truncation (aa 525-544) AND mutation on N-linked glycosylation site (with signal sequence) |
| 599 | MVVILDKRCY CNLLILILMI SECSVGILHY EKLSKIGLVK GVTRKYKIKS NPLTKDIVIK MIPNVSNMSQ CTGSVMENYK TRLNGILTPI KGALEIYKNN THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNT | Truncated NiV fusion glycoprotein (FcDelta22) at cytoplasmic tail (with signal sequence) |
| 612 | MKKINEGLLDSKILSA FNTVIALLGS IVIIVMNIMI IQNY-TRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QCT | NiVG protein attachment glycoprotein Truncated (Gc A 34) |
| 613 | ILHY EKLSKIGLVK GVTRKYKIKS NPLTKDIVIK MIP-NVSNMSQ CTGSVMENYK TRLNGILTPI KGALEIYKNN THDLVGDVRL AGVIMAGVAI GIATAAQITA GVALYEAMKN ADNINKLKSS IESTNEAVVK LQETAEKTVY VLTALQDYIN TNLVPTIDKI SCKQTELSLD LALSKYLSDL LFVFGPNLQD PVSNSMTIQA ISQAFGGNYE TLLRTLGYAT EDFDDLLESD SITGQIIYVD LSSYYIIVRV YFPILTEIQQ AYIQELLPVS FNNDNSEWIS IVPNFILVRN TLISNIEIGF CLITKRSVIC NQDYATPMTN NMRECLTGST EKCPRELVVS SHVPRFALSN GVLFANCISV TCQCQTTGRA ISQSGEQTLL MIDNTTCPTA VLGNVIISLG KYLGSVNYNS EGIAIGPPVF TDKVDISSQI SSMNQSLQQS KDYIKEAQRL LDTVNPSLIS MLSMIILYVL SIASLCIGLI TFISFIIVEK KRNT | Truncated mature NiV fusion glycoprotein (FcDelta22) at cytoplasmic tail |
| 614 | MSNKRTTVLIIISYTLFYLNNAAIVGFDFDKLNKIGWQGRVL-NYKIKGDPMTKDLVLKFIP-NIVNITECVREPLSRYNETVRRLLLPIHNMLGLYLNNTNAKMTG | gb:JQ001776:6129-81661 Organism:Cedar virus\|Strain |

TABLE 7-continued

| SEQ ID NO: | SEQUENCE | ANNOTATION |
|---|---|---|
| | LMIAGVIMGGIAIGIATAAQITAGFALYEAKKNTENIQKLT-DSIMKTQDSIDKLT-DSVGTSILILNKLQTYINNQLVPNLELLSCRQNKIEFDLMLTKYLVDLMTVIGPNINNPVNKDMTIQSLSLLFDGNYDIMM-SELGYTPQDFLD-LIESKSITGQIIYVDMENLYVVIRTYLPTLIEVPDAQIYEFNKITMSSNGGEYLSTIPNFILIRGNYMSNIDVATCYMTKASVIC-NQDYS-LPMSQNLRSCYQGETEYCPVEAVIASHSPRFALTNGVIFANCINTICRCQDNGKTITQNINQFVSMIDNSTCNDVMVDKFTIK-VGKYMGRKDINNINIQIG-PQIIIDKVDLSNEINKMNQSLKDSIFYLREAKRILDSVNISLISPSVQLFLIIISVLSFIILLIIIVYLYCK-SKHSYKYNKFIDDPDYYNDYKRERINGKASKSNNIYYVGD | Name:CG1a\|Protein Name:fusion glycoprotein\|Gene SymbokF (with signal sequence) |
| 615 | MALNKNMFSSLFLGYLLVYATTVQSSIHYDSLS-KVGVIKGLTYNYKIKGSPSTKLMVVKLIP-NIDSVKNCTQKQYDEYKNLVRKALEPVKMAIDTMLNNVKSGNNKYRFAGAIMAGVALGVATAATVTAGIALHRSNENA-QAIANMKSAIQNTNEAV-KQLQLANKQTLAVIDTIRGEINNNIIPVINQLSCDTIGLSVGIRLTQYYSEIITAFGPALQNPVNTRITIQAISSVFNGNF-DELLKIMGYTSGDLYEILHSELIR-GNIIDVDVDAGYIALEIEFPNLTLVPNAVVQELMPISYNIDGDEWVTLVPRFVLTRTTLLSNIDTSRCTITDSSVICDNDYALPM-SHELIGCLQGDTSKCA-REKWSSYVPKFALSDGLVYANCLNTICRCMDTDTPISQSLGATVSLLDNKRCSVYQVGDVLISVGSYL-GDGEYNADNVELGPPIVIDKIDIGNQLAGINQTLQE-AEDYIEKSEEFLKGVNPSIITLGSMVVLYIFMILIAIVSVIALVLSIKLTVKGNVVRQQFTYTQHVPSMENINYVSH | gb:NC_025352:5950-8712\|Organism:Mo-jiang virus\|Strain Name:Tongguan1\|Pro-tein Name:fusion pro-tein\|Gene SymbokF (with signal sequence) |
| 616 | MKKKTDNPTISKRGHNHSRGIKSRALLRETDNYSNGLIVEN-LVRNCHHPSKNNLNY-TKTQKRDSTIPYRVEERKGHYPKIKHLIDKSYKHIKRGKRRNGHNGNIITIILLLILILKTQMSEGAIHYETLSKIGLIKG-ITREYKVKGTPSSKDIVIKLIP-NVTGLNKCTNISMENYKEQLDKILIPINNIIELYANSTKSAPGNARFAGVIIAGVALGVAAAAQITAGIALHEARQNAER-INLLKDSISATNNAVAEL-QEATGGIVNVITGMQDYINTNLVPQIDKLQCSQIKTALDISLSQYYSEILTVFGPNLQNPVTTSMSIQAISQSFGG-NIDLLLNLLGYTANDLLDLLESKSITGQIT-YINLEHYFMVIRVYYPIMTTISNAYVQELIKISFNVDGSEWVSLVPSYILIRNSYLSNIDISECLITKNSVICRHDFAMPM-SYTLKECLTGDTEKCPREAVVTSYV-PRFAISGGVIYANCLSTTCQCYQTGKVIAQDGSQTLMMIDNQTCSIVRIEEILISTGKYLGSQEYNTMHVSVGNPVFTDKL-DITSQISNINQSIEQSKFYLDK-SKAILDKINLNLIGSVPISILFIIAILSLILSIITFVIVMIIVRRYNKYTPLINSDPSSRRSTIQDVYIIPNPGEHSIRSAAR-SIDRDRD | gb:NC_025256:6865-8853\|Organism:Bat Paramyxovirus Eid_hel/GH-M74a/GHA/2009\|Strain Name:BatPV/Eid_hel/GH-M74a/GHA/2009\|Pro-tein Name:fusion pro-tein\|Gene SymbokF (with signal sequence) |
| 27 | (GGGGGS)n wherein n is 1 to 6 | Peptide Linker |
| 618 | MPAENKKVRFENTTSDKGKIPSKVIKSYYGTMDIK-KINEGLLDSKILSAFNTVIALLGSIV-IIVMNIMIIQNYTRSTDNQAVIKDALQGIQQQIKGLADKIGTEIGPKVSLIDTSSTITIPANIGLLGSKISQSTASINEN-VNEKCKFTLPPLKIHECNISCPNPLP-FREYRPQTEGVSNLVGLPNNICLQKTSNQILKPKLISYTLPVVGQSGTCITDPLLAMDEGYFAYSHLERIGSCSRGVSKQRII-GVGEVLDRGDEVPSLFMTNVWTPPNPNTVYHCSAVYNNEFYYVLCAVSTVGDPILNSTYWSGSLMMTRLAVKPK-SNGGGYNQHQLALRSIEKGRYDKVMPYGPSGIKQGDTLYFPAVGFLVRTEFKYNDSNCPITKCQYSKPENCRLSMGIRPNSHYIL-RSGLLKYNLSDGENPKVVFIEISDQRLSIGSPSKIYDSLGQPVFYQASFSWDTMIKFGDVLTVNPLVVNWRN-NTVISRPGQSQCPRFNTCPEICWEGVYN-DAFLIDRINWISAGVFLDSNQTAENPVFTVFKDNEILYRAQLASEDTNAQKTITNCFLLKNKIWCISLVEIYDTGDNVIRPKLFAV-KIPEQCT | gb:AF2123021 Organ-ism:Nipah virus\|Strain Name:UNKNOWN-AF212302\|Protein Name:attachment gly-coprotein\|Gene Sym-bol:G (Uniprot Q9IH62) |
| 619 | MLSQLQKNYLDNSNQQGDKMNNPDKKLSVNFNPLELDKGQKDLNKSYYVKNKNYNVSNLLNESLHDIKFCIYCIFSLLIIIT-IINIITISIVITRLKVHEEN- | gb:JQ001776:8170-102751 Organism:Cedar virus\|Strain |

TABLE 7-continued

| SEQ ID NO: | SEQUENCE | ANNOTATION |
|---|---|---|
| | NGMESPNLQSIQDSLSSLTNMINTEITPRIGILVTATSVTLSSS INYVGTKTNQLVNELKDY-ITKSCGFKVPELKLHECNISCADPKISKSAMYSTNAYAELAG-PPKIFCKSVSKDPDFRLKQIDYVIPVQQDRSICMNNPLLDISDG FFTYIHYEGINSCKKSDSFKVLL-SHGEIVDRGDYRPSLYLLSSH-YHPYSMQVINCVPVTCNQSSFVFCHISNNTKTLDNSDYSSDEYY ITYFNGIDRPKTKKIPINNMTADNRYIHFTFSGGGGVCLGEEF-IIPVTTVINTDVFTHDYCESFNCSVQTGKSLKEICSESLRSPTN SSRYNLNGIMIISQNNMTDFKIQLNGITYNKLSFG-SPGRLSKTLGQVLYYQSSMSWDTYLKAGFVEKWKPFTPNWMNNT VISRPNQGNCPRY-HKCPEICYGGTYNDIAPLDLGKDMYVSVILDSDQLAENPEITVF NSTTILYKERVSKDELNTRSTTTSCFLFLDEPWCIS-VLETNRFNGKSIRPEIYSYKIPKYC | Name:CG1a\|Protein Name:attachment glycoprotein\|Gene Symbol:G |
| 620 | MPQKTVEFINMNSPLER-GVSTLSDKKTLNQSKITKQGYFGLGSHSERNWKKQKNQNDHYMT VSTMILEILVVLGIMFNLIVLTMVYYQND-NINQRMAELTSNITVLNLNLNQLT-NKIQREIIPRITLIDTATTITIPSAITYILATLTTRISELLPSI NQKCEFKTPTLVLNDCRINCTP-PLNPSDVKMSSLATNLVAHGPSPCRNFSSVPTIY-YYRIPGLYNRTALDERCILNPRLTISSTKFAYVHSEYDKNCTRG FKYYELMTFGEILEGPEKEPRMFSRSFYSPTNAVNY-HSCTPIVTVNEGYFLC-LECTSSDPLYKANLSNSTFHLVILRHNKDEKIVSMPSFNLSTDQ EYVQIIPAEGGGTAESGNLYFPCIGRLLHKRVTHPLCK-KSNCSRTDDESCLKSYYNQG-SPQHQVVNCLIRIRNAQRDNPTWDVITVDLTNTYPGSRSRIFGS FSKPMLYQSSVSWHT-LLQVAEITDLDKYQLDWLDTPYISRPGGSECPFGNYCPTVCWEG TYNDVYSLTPNNDLFVTVYLKSEQVAENPY-FAIFSRDQILKEFPLDAW-ISSARTTTISCFMFNNEIWCIAALEITRLNDDIIRPIYYSFWLP TDCRTPYPHTGKMTRVPLRSTYNY | gb:NC_025256:9117-110151 Organism:Bat Paramyxovirus Eid_hel/GH-M74a/GHA/2009\|Strain Name:BatPV/Eid_hel/GH-M74a/GHA/20091 Protein Name:glycoprotein\|Gene SymbokG |
| 621 | MATNRDNTITSAEVSQEDKVKKYYGVETAEKVADSIS-GNKVFILM-NTLLILTGAIITITLNITNLTAAKSQQNMLKIIQDDVNAKLEMF VNLDQLVKGEIKPKVSLIN-TAVSVSIPGQISNLQTKFLQKYVYLEESITKQCTCNPLSGIFPT SGPTYPPTDKPDDDTTDDDKVDTTIKPIEYPKPDGCNRT-GDHFTMEPGANFYTVPNLGPASS-NSDECYTNPSFSIGSSIYMFSQEIRKTDCTAGEILSIQIVLGRI VDKGQQGPQASPLLVWAV-PNPKIINSCAVAAGDEMGWVLCSVTLTAASGEPIPHMFDGFWLY KLEPDTEVVSYRITGYAYLLDKQYDSVFIGKGG-GIQKGNDLYFQMYGLSRNRQSFKALCEHG-SCLGTGGGGYQVLCDRAVMSFGSEESLITNAYLKVNDLASGKPV IIGQTFPPSDSYKGSNGRMYTIGDKYGLYLAPSSWNRYLRFG-ITPDISVRSTTWLKSQDPIM-KILSTCTNTDRDMCPEICNTRGYQDIFPLSEDSEYYTYIGITPN NGGTKNFVAVRDSDGHIASIDILQNYYSITSATISCFMYKDEI-WCIAITEGKKQKDNPQRI-YAHSYKIRQMCYNMKSATVTVGNAKNITIRRY | gb:NC_025352:8716-112571 Organism:Mojiang virus\|Strain Name:Tongguan1\|Protein Name:attachment glycoprotein\|Gene SymbokG |
| 622 | FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NivG protein attachment glycoprotein Without cytoplasmic tail Uniprot Q9IH62 |
| 623 | FNTVIALLGSI IIIVMNIMII QNYTRTTDNQ ALIKESLQSV QQQIKALTDK IGTEIGPKVS LIDTSSTITI PANIGLLGSK ISQSTSSINE NVNDKCKFTL | Hendra virus G protein Uniprot O89343 Without cytoplasmic tail |

TABLE 7-continued

| SEQ ID NO: | SEQUENCE | ANNOTATION |
|---|---|---|
| | PPLKIHECNI SCPNPLPFRE YRPISQGVSD LVGLPNQICL QKTTSTILKP RLISYTLPIN TREGVCITDP LLAVDNGFFA YSHLEKIGSC TRGIAKQRII GVGEVLDRGD KVPSMFMTNV WTPPNPSTIH HCSSTYHEDF YYTLCAVSHV GDPILNSTSW TESLSLIRLA VRPKSDSGDY NQKYIAITKV ERGKYDKVMP YGPSGIKQGD TLYFPAVGFL PRTEFQYNDS NCPIIHCKYS KAENCRLSMG VNSKSHYILR SGLLKYNLSL GGDIILQFIE IADNRLTIGS PSKIYNSLGQ PVFYQASYSW DTMIKLGDVD TVDPLRVQWR NNSVISRPGQ SQCPRFNVCP EVCWEGTYND AFLIDRLNWV SAGVYLNSNQ TAENPVFAVF KDNEILYQVP LAEDDTNAQK TITDCFLLEN VIWCISLVEI YDTGDSVIRP KLFAVKIPAQ CSES | |
| 624 | MVVILDKRCY CNLLILILMI SECSVG | Signal sequence |
| 625 | GGGGS | Peptide linker |
| 626 | (GGGGS)n wherein n is 1 to 10 | Peptide linker |
| 627 | GGGGS | Peptide linker |
| 628 | PAENKKVR FENTTSDKGK IPSKVIKSYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein (602 aa) Without N-terminal methionine |
| 629 | KVR FENTTSDKGK IPSKVIKSYY GTMDIKKINE GLLDSKILSA FNTVIALLGS IV TABLE 7-continued

| SEQ ID NO: | SEQUENCE | ANNOTATION |
|---|---|---|
| 631 | KGK IPSKVIKSYY GTMDIKKINE GLLDSKILSA FNTVI-ALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A15 Without N-terminal methionine |
| 632 | SKVIKSYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A20 Without N-terminal methionine |
| 633 | SYY GTMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A25 Without N-terminal methionine |
| 634 | TMDIKKINE GLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QC | NiVG protein attachment glycoprotein Truncated A30 Without N-terminal methionine |
| 635 | KKINEGLLDSKILSA FNTVIALLGS IVIIVMNIMI IQNY-TRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNQHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PAICAEGVYN | NiVG protein attachment glycoprotein Truncated and mutated (E501 A, W504A, Q530A, E533A) NiVG protein (Gc Δ 34) Without N-terminal methionine |

TABLE 7-continued

| SEQ ID NO: | SEQUENCE | ANNOTATION |
|---|---|---|
| | DAFLIDRINW ISAGVFLDSN ATAANPVFTV FKDNEILYRA QLASEDTNAQ KTITNCFLLK NKIWCISLVE IYDTGDNVIR PKLFAVKIPE QCT | |
| 636 | MADSKLVSL NNNLSGKIKD QGKVIKNYYG TMDIKKINDG LLDSKILGAF NTVIALLGSI IIIVMNIMII QNYTRTTDNQ ALIKESLQSV QQQIKALTDK IGTEIGPKVS LIDTSSTITI PANIGLLGSK ISQSTSSINE NVNDKCKFTL PPLKIHECNI SCPNPLPFRE YRPISQGVSD LVGLPNQICL QKTTSTILKP RLISYTLPIN TREGVCITDP LLAVDNGFFA YSHLEKIGSC TRGIAKQRII GVGEVLDRGD KVPSMFMTNV WTPPNPSTIH HCSSTYHEDF YYTLCAVSHV GDPILNSTSW TESLSLIRLA VRPKSDSGDY NQKYIAITKV ERGKYDKVMP YGPSGIKQGD TLYFPAVGFL PRTEFQYNDS NCPIIHCKYS KAENCRLSMG VNSKSHYILR SGLLKYNLSL GGDIILQFIE IADNRLTIGS PSKIYNSLGQ PVFYQASYSW DTMIKLGDVD TVDPLRVQWR NNSVISRPGQ SQCPRFNVCP EVCWEGTYND AFLIDRLNWV SAGVYLNSNQ TAENPVFAVF KDNEILYQVP LAEDDTNAQK TITDCFLLEN VIWCISLVEI YDTGDSVIRP KLFAVKIPAQ CSES | Hendra virus G protein Uniprot 089343 Without N-terminal methionine |
| 637 | KKINEGLLDSKILSA FNTVIALLGS IVIIVMNIMI IQNYTRSTDN QAVIKDALQG IQQQIKGLAD KIGTEIGPKV SLIDTSSTIT IPANIGLLGS KISQSTASIN ENVNEKCKFT LPPLKIHECN ISCPNPLPFR EYRPQTEGVS NLVGLPNNIC LQKTSNQILK PKLISYTLPV VGQSGTCITD PLLAMDEGYF AYSHLERIGS CSRGVSKQRI IGVGEVLDRG DEVPSLFMTN VWTPPNPNTV YHCSAVYNNE FYYVLCAVST VGDPILNSTY WSGSLMMTRL AVKPKSNGGG YNHQLALRS IEKGRYDKVM PYGPSGIKQG DTLYFPAVGF LVRTEFKYND SNCPITKCQY SKPENCRLSM GIRPNSHYIL RSGLLKYNLS DGENPKVVFI EISDQRLSIG SPSKIYDSLG QPVFYQASFS WDTMIKFGDV LTVNPLVVNW RNNTVISRPG QSQCPRFNTC PEICWEGVYN DAFLIDRINW ISAGVFLDSN QTAENPVFTV FKDNEILYRA QLASEDTNAQ KTITNCFLLK NKIWCISLVE IYDTGDNVIR PKLFAVKIPE QCT | NiVG protein attachment glycoprotein Truncated (Gc Δ 34) Without N-terminal-methionine |
| 638 | LSQLQKNYLDNSNQQGDKMNNPDKKLSVNFNPLELDKGQKDLNK SYYVKNKNYNVSNLLNESLHDIKFCIYCIFSLLIIITIINIIT-ISIVITRLKVHEEN-NGMESPNLQSIQDSLSSLTNMINTEITPRIGILVTATSVTLSSS INYVGTKTNQLVNELKDY-ITKSCGFKVPELKLHECNISCADPKISKSAMYSTNAYAELAG-PPKIFCKSVSKDPDFRLKQIDYVIPVQQDRSICMNNPLLDISDG FFTYIHYEGINSCKKSDSFKVLL-SHGEIVDRGDYRPSLYLLSSH-YHPYSMQVINCVPVTCNQSSFVFCHISNNTKTLDNSDYSSDEYY ITYFNGIDRPKTKKIPINNMTADNRYIHFTFSGGGGVCLGEEF-IIPVTTVINTDVFTHDYCESFNCSVQTGKSLKEICSESLRSPTN SSRYNLNGIMIISQNNMTDFKIQLNGITYNKLSFG-SPGRLSKTLGQVLYYQSSMSWDTYLKAGFVEKWKPFTPNWMNNT VISRPNQGNCPRY-HKCPEICYGGTYNDIAPLDLGKDMYVSVILDSDQLAENPEITVF NSTTILYKERVSKDELNTRSTTTSCFLFLDEPWCIS-VLETNRFNGKSIRPEIYSYKIPKYC | gb:JQ001776:8170-102751 Organism:Cedar virus\|Strain Name:CG1a\|Protein Name:attachment glycoprotein\|Gene-Symbol:G Without N-terminal methionine |
| 639 | PQKTVEFINMNSPLER-GVSTLSDKKTLNQSKITKQGYFGLGSHSERNWKKQKNQNDHYMT VSTMILEILVVLGIMFNLIVLTMVYYQND-NINQRMAELTSNITVLNLNLNQLT-NKIQREIIPRITLIDTATTITIPSAITYILATLTTRISELLPSI NQKCEFKTPTLVLNDCRINCTP-PLNPSDGVKMSSLATNLVAHGPSPCRNFSSVPTIY-YRIPGLYNRTALDERCILNPRLTISSSTKFAYVHSEYDKNCTRG FKYYELMTFGEILEGPEKEPRMFSRSFYSPTNAVNY-HSCTPIVTVNEGYFLC-LECTSSDPLYKANLSNSTFHLVILRHNKDEKIVSMPSFNLSTDQ EYVQIIPAEGGGTAESGNLYFPCIGRLLHKRVTHPLCK-KSNCSRTDDESCLKSYYNQG-SPQHQVVNCLIRIRNAQRDNPTWDVITVDLTNTYPGSRSRIFGS FSKPMLYQSSVSWHT-LLQVAEITDLDKYQLDWLDTPYISRPGGSECPFGNYCPTVCWEG TYNDVYSLTPNNDLFVTVYLKSEQVAENPY- | gb:NC_025256:9117-110151 Organism:Bat Paramyxovirus Eid_hel/GH-M74a/GHA/2009\|Strain Name:BatPV/Eid_hel/GH-M74a/GHA/20091 Protein Name:glycoprotein\|Gene SymbokG Without N-terminal-methionine |

| SEQ ID NO: | SEQUENCE | ANNOTATION |
|---|---|---|
| | FAIFSRDQILKEFPLDAW-ISSARTTTISCFMFNNEIWCIAALEITRLNDDIIRPIYYSFWLPTDCRTPYPHTGKMTRVPLRSTYNY | |
| 640 | ATNRDNTITSAEVSQEDKVKKYYGVETAEKVADSIS-GNKVFILMNTLLILTGAIITITLNIT-NLTAAKSQQNMLKIIQDDVNAKLEMFVNLDQLVKGEIKPKVSLINTAVSVSIPGQISNLQTKFLQKYVYLEESITKQCTCNPLSGIFPTSGPTYPPTDKPDDDTTDDDKVDTTIKPIEYPKPDGCNRT-GDHFTMEP-GANFYTVPNLGPASSNS

TABLE 7-continued

| SEQ ID NO: | SEQUENCE | ANNOTATION |
|---|---|---|
| | TDKVDISSQI SSMNQSLQQS KDYIKEAQKI LDTVNPSLIS MLSMIILYVL SIAALCIGLI TFISFVIVEK KRGNYSRLDD RQVRPVSNGD LYYIGT | |
| 644 | IHYDSLSKVGVIKGLTYNYKIKGSPSTKLMWKLIP-NIDSVKNCTQKQYDEYKNLVRKALEPVKMAIDTMLNNVKSGNNK YRFAGAIMAGVALGVATAATVTAGIALHRSNENA-QAIANMKSAIQNTNEAV-KQLQLANKQTLAVIDTIRGEINNNIIPVINQLSCDTIGLSVGIR LTQYYSEIITAFGPALQNPVNTRITIQAISSVFNGNF-DELLKIMGYTSGDLYEILHSELIR-GNIIDVDVDAGYIALEIEFPNLTLVPNAVVQELMPISYNIDGDE WVTLVPRFVLTRTTLLSNIDTSRCTITDSSVICDNDYALPM-SHELIGCLQGDTSKCA-REKWSSYVPKFALSDGLVYANCLNTICRCMDTDTPISQSLGAT VSLLDNKRCSVYQVGDVLISVGSYL-GDGEYNADNVELGPPIVIDKIDIGNQLAGINQTLQE-AEDYIEKSEEFLKGVNPSIITLGSMVVLYIFMILIAIVSVIALV LSIKLTVKGNVVRQQFTYTQHVPSMENINYVSH | gb:NC_025352:5950-8712\|Organism:IVIo-jiang virus\|Strain Name:Tongguan1\|Pro-tein Name:fusion pro-tein\|Gene SymbokF (without signal se-quence) |
| 645 | (GGGS)n wherein n is 1 to 10 | Peptide linker |
| 646 | GGGGSGGGGSGGGGS | Peptide linker |
| 647 | TTAASGSSGGSSSGA | Peptide linker |
| 648 | GSTSGSGKPGSGEGSTKG | Peptide linker |

TABLE 8

HCDRs using the Chothia Numbering Scheme

| CD8 Binder | H-CDR1 Sequence | SEQ ID NO: | H-CDR2 Sequence | SEQ ID NO: | H-CDR3 Sequence | SEQ ID NO: |
|---|---|---|---|---|---|---|
| 1 | GGTFSSY | 653 | DPSDGN | 701 | ERAAAGYYYYMDV | 148 |
| 2 | GGTFNTY | 654 | DPSSGG | 702 | EHAAGTYYYYMDV | 149 |
| 3 | GGTFSSY | 653 | DPSGGN | 703 | ERAAAGYYYYMDV | 148 |
| 4 | GYTFTGY | 655 | NPNNGD | 704 | EGYYYYGMDV | 649 |
| 5 | GYTFTDY | 656 | NPNSGG | 705 | EGDYYYGMDA | 150 |
| 6 | GYTFTRY | 657 | NPNDGS | 706 | ERGGMPDY | 151 |
| 7 | GYTFTSY | 658 | NPNSGG | 705 | GHGIPKY | 152 |
| 8 | GYTFTSY | 658 | NPNSGN | 707 | VRSGSPQH | 153 |
| 9 | GHTFSRH | 659 | NPNSGN | 707 | GGPWIVDAFDI | 154 |
| 10 | GYTFTSY | 658 | SAHNGV | 708 | GIAVAGTDY | 650 |
| 11 | GGTFSNT | 660 | NPSGGS | 709 | EATWGPYYYYMDV | 155 |
| 12 | GYTFTRS | 661 | SPYNGN | 710 | NKDGLQH | 156 |
| 13 | GDTFTGY | 662 | NPNSGD | 711 | DAKRVGYYYYMDV | 157 |
| 14 | GYTFTRY | 657 | NPNSGG | 705 | LVGGSPDY | 158 |
| 15 | GYTFTNY | 663 | NPNSGG | 705 | GAMVDY | 159 |
| 16 | GGTFSNT | 660 | NPSDGD | 712 | GNYVGSYYYGMDV | 160 |
| 17 | GYTFTNY | 663 | NPNSGD | 711 | DSRGDWYFDL | 161 |
| 18 | GYGFTRY | 664 | DPSGGS | 713 | HGGRGLADY | 162 |
| 19 | GYTFTSR | 665 | DPKSGD | 714 | LKELSSILDAFDI | 163 |
| 20 | GYTFTSY | 658 | NPGAGS | 715 | ERFGTGYYYYMDV | 164 |
| 21 | GFTFSNS | 666 | SGDGGT | 716 | VIGEMVDDAFDL | 165 |
| 22 | GYTFTGY | 655 | NPNSGD | 711 | ERLFGTYYYYMDV | 166 |
| 23 | GYTFTTY | 667 | IPIFGT | 717 | ADGELTDY | 167 |
| 24 | GFTFSSY | 668 | -GTGGG | 718 | HHLPAHYYYYMDV | 168 |
| 25 | GGTFSRY | 669 | NPNSGD | 711 | DVPAGRYYYYMDV | 169 |
| 26 | GNTFTSY | 670 | NPSDGS | 719 | DRGVGRYYYYMDV | 170 |
| 27 | GGTFSRY | 669 | NPSDGS | 719 | DSRYGRYYYYMDV | 171 |
| 28 | GGTFSNY | 671 | NPNGGS | 720 | EIVVGPYYYYMDV | 172 |
| 29 | GGTFTRY | 672 | NPNSGD | 711 | GMVRGPYYYYMDV | 173 |
| 30 | GGTFSSY | 653 | NPSGGS | 709 | EGVTGPYYYYMDV | 174 |
| 31 | GGTFSRF | 673 | NPSDGS | 719 | DAAAGTRYYYYGMDV | 175 |
| 32 | GGTFSSH | 674 | NPSGGS | 709 | ELYSSTYYYYMDV | 176 |
| 33 | GGTFSSY | 653 | NPNTGG | 721 | ALYSGPYYYYMDV | 177 |
| 34 | GFTFSNS | 666 | SGSGGS | 722 | EHAAGTYYYYMDV | 149 |

TABLE 8-continued

HCDRs using the Chothia Numbering Scheme

| CD8 Binder | H-CDR1 Sequence | SEQ ID NO: | H-CDR2 Sequence | SEQ ID NO: | H-CDR3 Sequence | SEQ ID NO: |
|---|---|---|---|---|---|---|
| 35 | GGTFGSY | 675 | SGYNGD | 723 | DSLVGRYYYYMDV | 178 |
| 36 | GYIFTDY | 676 | SADNGN | 724 | RSELDY | 179 |
| 37 | GYTFTSY | 658 | SPNSGA | 725 | GDDNDY | 180 |
| 38 | GYTFTSY | 658 | NPNSGN | 707 | GEEVDY | 181 |
| 39 | GYTFTSY | 658 | NPSGGS | 709 | GRRVPDY | 182 |
| 40 | GYTFTDY | 656 | NPKSGA | 726 | GKVTTDY | 183 |
| 41 | GFTFSSF | 677 | SESGDS | 727 | GRELIEY | 184 |
| 42 | GFTFDDY | 678 | -GTGGG | 718 | VYDFPDV | 185 |
| 43 | GYTFTDS | 679 | NPSNGD | 728 | STYSHIDY | 186 |
| 44 | GYTFTNY | 663 | SPSDGS | 729 | EDSSGFDY | 187 |
| 45 | GYTFMNY | 680 | NPSGGS | 709 | DQGGGFDY | 188 |
| 46 | GYTFTSY | 658 | DPEDGE | 730 | DQGWGMDV | 189 |
| 47 | GYTFTSY | 658 | NPKSGR | 731 | LTEGIPDY | 190 |
| 48 | GYTLNDY | 681 | NPGGGS | 732 | DRYGPFDY | 191 |
| 49 | GYTFTSY | 658 | NPKTGD | 733 | LVAGGAPDY | 192 |
| 50 | GYTFTGY | 655 | DPSDGY | 734 | DGFTGDIAY | 193 |
| 51 | GYTFTGY | 655 | NPNSGG | 705 | VDDSSSPDY | 194 |
| 52 | GYTFTGY | 655 | MPISGT | 735 | GPDGTEVDY | 195 |
| 52 | GYTFTNH | 682 | NPNSGN | 707 | SESGSDLDY | 196 |
| 54 | GYTFTNY | 663 | SPTSGD | 736 | EVEIEGYMDV | 197 |
| 55 | GYTFTSY | 658 | NPNSGD | 711 | DLDDDWYMDV | 198 |
| 56 | GYTFTSY | 658 | DPSGDI | 737 | DSTTWDAFDI | 199 |
| 57 | GYTFTDY | 656 | NPNSGG | 705 | VLVGSGSPDY | 200 |
| 58 | GYTFTEN | 683 | ETSGGS | 738 | EAAAGLDFQH | 201 |
| 59 | GYTFASY | 684 | NPNSGG | 705 | ANSWDADY | 202 |
| 60 | GFTFSNS | 666 | SGSGVT | 739 | EHSSSWYTFDY | 203 |
| 61 | GYTFTAY | 685 | NPNSGG | 705 | DDDSSGYYLDY | 204 |
| 62 | GYTFTNY | 663 | NPSGGS | 709 | ASGDYMDLIDYMDY | 205 |
| 63 | GYTFTDY | 656 | NPDSGG | 740 | VGSSGYLAPTH | 206 |
| 64 | GYPFTDY | 686 | NPNSGN | 707 | VRGDGYNLGDY | 207 |
| 65 | GYTFSDY | 687 | NPNSGG | 705 | DVDTAMGAGDY | 208 |
| 66 | GYTFTDY | 656 | NPSGGS | 709 | VARWGYGDYPDY | 209 |
| 67 | GDTFTTH | 688 | SPSDGS | 729 | DRNGDYYYGMDV | 210 |
| 68 | GDTFTNY | 689 | NPISGG | 741 | EGLGSSWYVLDY | 211 |
| 69 | GYTFTSY | 658 | SADNGD | 742 | DGSHYGYYGMDV | 212 |
| 70 | GYTFTSY | 658 | SPIYGT | 743 | PGPEGYYYGMDV | 213 |
| 71 | GYTFTDN | 690 | NPNSGN | 707 | YHWDYGDYRFDY | 214 |
| 72 | GYTFTSY | 658 | NPNSGN | 707 | VEIDYGDSPPDY | 215 |
| 73 | GGTSSSY | 691 | NPSDGD | 712 | GAEWELRYAFDI | 216 |
| 74 | GYTFTTY | 667 | NPSGGT | 744 | ETYYGLYYYGMDV | 217 |
| 75 | GYTFTSY | 658 | NPKSGN | 745 | APSLRGYSYGPDY | 218 |
| 76 | GGTFTSY | 692 | NPSGGS | 709 | DRQERYYYYMDV | 219 |
| 77 | GYTFTSY | 658 | NPSDGS | 719 | DRSYGDYYYGMDV | 220 |
| 78 | GGTFTSY | 692 | NPGGGN | 746 | EVFSENYYYYMDV | 221 |
| 79 | GYTFTSY | 658 | NPSDGS | 719 | EWDYTHYYYGMDV | 222 |
| 80 | GNTFTSH | 693 | DPEDGE | 730 | GDSSGYYQYYFDY | 223 |
| 81 | GYTFTSY | 658 | TPVFGI | 747 | GSWDSSSWYIPEY | 224 |
| 82 | GFTFSDY | 694 | NPRGGS | 748 | LVWGGAYYYYMDV | 225 |
| 83 | GYTFTSY | 658 | NPNNGD | 704 | PVFSGSYYWYFDP | 226 |
| 84 | GYTFTSY | 658 | NPSGGG | 749 | DQAVAGPYYYGMDV | 227 |
| 85 | GGTFSSY | 653 | NPGSGN | 750 | DRWLAGPYYYGMDV | 228 |
| 86 | GYMFTGH | 695 | IPIFGT | 717 | VMGPVDYYYYGMDV | 229 |
| 87 | GYIFSNY | 696 | NPSDGS | 719 | DLGPFGSYYYYMDV | 230 |
| 88 | GFTFSSY | 668 | NGDGDD | 751 | EGVVVPPYYYYMDV | 231 |
| 89 | GYTFTTY | 667 | DPNSGD | 752 | SSGWSRYYYYMDV | 232 |
| 90 | GSTFTNY | 697 | NPSGGS | 709 | DNGMTTGYYYYMDV | 233 |
| 91 | GYTFTSY | 658 | NPSGGS | 709 | DRAMVTGYYYGMDV | 234 |
| 92 | GYTFTSY | 658 | NPSDGN | 753 | DRGYGDRGYYYGMDV | 235 |
| 93 | GGTLSSY | 698 | NTYNGN | 754 | SPKATADYYYYMDV | 236 |
| 94 | GYTFTSY | 658 | NPSDGI | 755 | STVTPSYYYYGMDV | 237 |
| 95 | GYTFTSH | 699 | NPRDGD | 756 | EPVAGTGYYYYYGMDV | 238 |
| 96 | GGTFNSY | 700 | NPNSGN | 707 | DNLAGFWSDYYYYGMDV | 239 |
| 97 | GRTFSGY | 1064 | SRGGLS | 1065 | DRSDLYEITAASNIDS | 1063 |

TABLE 9

LCDRs using the Chothia Numbering Scheme

| CD8 Binder | L-CDR1 Sequence | SEQ ID NO: | L-CDR2 Sequence | SEQ ID NO: | L-CDR3 Sequence | SEQ ID NO: |
|---|---|---|---|---|---|---|
| 1 | RASQSISSYLN | 240 | AASSLQS | 294 | QQSYSTPLT | 333 |
| 2 | QASQDISNYLN | 241 | AASSLQS | 294 | QQSYSNLVS | 334 |
| 3 | RASQSISSYLN | 240 | AASSLQS | 294 | QQSYSTPLT | 333 |
| 4 | RSSQSLLHSNGYNYLD | 242 | LGSNRAS | 295 | MQALQTPFT | 335 |
| 5 | RSSQSLLHSNGYNYLD | 242 | LGSNRAS | 295 | MQGLQTPHT | 336 |
| 6 | RASQSISRNLN | 243 | KASNLKG | 296 | QQTYSAPL | 337 |
| 7 | RSSQSLLHSNGYNYLD | 242 | LGSNRAS | 295 | MQTLQTPLT | 338 |
| 8 | RASQSVSASDLA | 244 | GASTRAT | 297 | QQYGDSPGS | 339 |
| 9 | QASQDIGNYLN | 245 | AASTLQR | 298 | QQANSFPPT | 340 |
| 10 | RASQSISTHLA | 246 | GASTRAT | 297 | QQYGNSRT | 341 |
| 11 | RASQTISNYLN | 247 | AASTLQS | 299 | QQSYSTPPT | 342 |
| 12 | RASQGIRNDLG | 248 | DASTLQS | 300 | QQSYSSPYT | 343 |
| 13 | RASQSISNYLN | 249 | AASSLQS | 294 | QQSYSTPYT | 344 |
| 14 | RSSQSLLHSNGYNYLD | 242 | LGSNRAS | 295 | MQGAHWPPT | 345 |
| 15 | RASQGISDSLA | 250 | GASSLRS | 301 | QQSYRTPYT | 346 |
| 16 | RASQSISNYLN | 249 | AASSLQS | 294 | QESFTTQWT | 347 |
| 17 | QASQDIHNYLN | 251 | DASNLET | 302 | QQANSFPPT | 340 |
| 18 | QASQDISNYLN | 241 | SASSLQS | 303 | QQRSNWPLYT | 348 |
| 19 | RASQSISDWLA | 252 | AASSLQT | 304 | QQAISFPIT | 349 |
| 20 | QASQDISNYLN | 241 | SASTLQS | 305 | QQSYSSPFT | 350 |
| 21 | RASQSISTWLA | 253 | AASTLQS | 299 | QQAISFPLT | 351 |
| 22 | RASQSISNYLN | 249 | AASTLQS | 299 | QQSYTFPIT | 352 |
| 23 | RSSQSLLHSNGYNYLD | 242 | DASHLET | 306 | QQYYSYPPT | 353 |
| 24 | QASQDISNYLN | 241 | AASTLHS | 307 | QQSYSAPLT | 354 |
| 25 | QASQDISNYLN | 241 | AASTLQS | 299 | QQSFSTFYT | 355 |
| 26 | QASQDISNYLN | 241 | AASTLQS | 299 | QQSYSIPFT | 356 |
| 27 | RASQSINRFLN | 254 | AASSLQN | 308 | QQSYSTPYT | 344 |
| 28 | RASQSISSYLN | 240 | AASSLQS | 294 | QQSYSTPLT | 333 |
| 29 | QASQDISNYLN | 241 | AASTLQS | 299 | QQSYSTPIT | 357 |
| 30 | RASQSVSTYLN | 255 | AASSLQS | 294 | QQSYTIPST | 358 |
| 31 | QASQDIAKYLN | 256 | AASSLQS | 294 | QQSYSAPPT | 359 |
| 32 | QASQGITNYLN | 257 | GASSLQS | 309 | QQSYSTPWT | 360 |
| 33 | RASQSISSYLN | 240 | AASSLQS | 294 | QQSYSTPLT | 333 |
| 34 | QASQDIHNYLN | 251 | AASTLQS | 299 | QQSYTTPLT | 361 |
| 35 | QASQDISNYLN | 241 | SAFSLQS | 310 | QQSYSAPIT | 362 |
| 36 | RASQSISSYLN | 240 | SASNLQS | 311 | QQRSNWPPVT | 363 |
| 37 | QANQDISNFLE | 258 | DASSLES | 312 | QQSYSIPIT | 364 |
| 38 | RASQGISNNLN | 259 | EASTLES | 313 | QQSYSTPLT | 333 |
| 39 | RSSQSLLHSNGYNYLD | 242 | GASTLET | 314 | MQGLQPPGT | 365 |
| 40 | RASQSISRSLV | 260 | AASTLQT | 315 | QQSYNHFRT | 366 |
| 41 | QASQDISNYLN | 241 | DASNLET | 302 | QRSDSTPLT | 367 |
| 42 | QASHDISKSLN | 261 | GASTLQS | 316 | QQLNSYPRT | 368 |
| 43 | RASQDIGAYLA | 262 | AASSLQS | 294 | QQSYSIPYT | 369 |
| 44 | RASQSISSYLA | 263 | AASSLQS | 294 | QQSYSTPYT | 344 |
| 45 | RASQGIRSYLA | 264 | GASNLET | 317 | QQSYSTPYT | 344 |
| 46 | RASQSISSYLN | 240 | AASSLQS | 294 | QQTYSTPYT | 370 |
| 47 | RASQNIGTWLA | 265 | AASTLQS | 299 | QQSYSTPQT | 371 |
| 48 | RASQTISYYLN | 266 | AASTLQS | 299 | QQSYRTPYT | 346 |
| 49 | RSSQSLLHSNGYNYLD | 242 | MGSNRAS | 318 | MQGTHWPT | 372 |
| 50 | RASQNINNYLN | 267 | GASSLQS | 309 | QQTFSLPYT | 373 |
| 51 | RASQTISTYLN | 268 | DASNLET | 302 | QQSYSTPYT | 344 |
| 52 | RASRGIGNDLA | 269 | DASTLET | 319 | QQGYNMPLT | 374 |
| 52 | RASQTIGNYVN | 270 | GASNLHT | 320 | QQTYSAPLT | 375 |
| 54 | RASQFIGSWLA | 271 | AASTLQS | 299 | QQSYSFPWT | 376 |
| 55 | RASQSISSWMA | 272 | DASNLET | 302 | QQTYSTPYI | 377 |
| 56 | RASQGISNNLN | 259 | DASNLET | 302 | QQSYSSPWT | 378 |
| 57 | KSSQSVLYSSNNKNYLA | 273 | WASTRES | 321 | QQYASAPRT | 379 |
| 58 | RASQSISSYLN | 240 | KTSSLES | 322 | QQSFTIPYT | 380 |
| 59 | RVSQGISSYLN | 274 | GASSLQS | 309 | QQSYSTPLT | 333 |
| 60 | RASQSISDWLA | 252 | DASNLET | 302 | QQSYSTPLT | 333 |
| 61 | RASQGISNYLA | 275 | SASNLQS | 311 | QQTYRTPPT | 381 |
| 62 | RASQSIRNYLT | 276 | SASNLQS | 311 | QQSYSTPLT | 333 |
| 63 | RASQNIRLYLN | 277 | AASTLQS | 299 | QQSLTTPFT | 382 |
| 64 | QASQDIRKFLN | 278 | AASSLQS | 294 | QQLNGYPGT | 383 |
| 65 | RASQSISSYLN | 240 | TASNLQS | 323 | QQSYSLPLT | 384 |
| 66 | QASQDISNYLS | 279 | DASNLQS | 324 | QQTYTTPRT | 385 |
| 67 | RASQNVRSWLA | 280 | AASSLQS | 294 | QQSYNTPYT | 386 |
| 68 | RASQGIGNDLG | 281 | AASSLQS | 294 | QQSYAPPPT | 387 |

TABLE 9-continued

LCDRs using the Chothia Numbering Scheme

| CD8 Binder | L-CDR1 Sequence | SEQ ID NO: | L-CDR2 Sequence | SEQ ID NO: | L-CDR3 Sequence | SEQ ID NO: |
|---|---|---|---|---|---|---|
| 69 | RASQSISNWLA | 282 | GASNLET | 317 | QQSYSTPPT | 342 |
| 70 | RSSQSLLHSNGYNYLD | 242 | LGSNRAS | 295 | MQGLQTPLT | 388 |
| 71 | RASQSISSYLN | 240 | LASSLQS | 325 | QQSDSIPVT | 389 |
| 72 | QASQDISNYLN | 241 | STSSLQS | 326 | QQSYSTPYN | 390 |
| 73 | RASESIGSWLA | 283 | AASSLQS | 294 | QQSYSTPYT | 344 |
| 74 | RASQSISNYLN | 249 | AASSLQR | 327 | QQSYSTPLT | 333 |
| 75 | RASQSVTSNYLA | 284 | GASTRAT | 297 | QHYGSSPA | 391 |
| 76 | RASQSISSYLN | 240 | AASSLQS | 294 | QQSYSTPLT | 333 |
| 77 | RASQGISSYLA | 285 | AASTLQS | 299 | QQSYSTPPT | 342 |
| 78 | RASQDIGNYLN | 286 | AASSLQS | 294 | QQAYTYPYT | 392 |
| 79 | QASQDISNYLN | 241 | GASSLQS | 309 | QQSYTTPNT | 393 |
| 80 | RASQGISNYLA | 275 | AASTLQS | 299 | QQSYSTPYT | 344 |
| 81 | RASQGISNGLS | 287 | DASNLET | 302 | QQSYSTPFT | 394 |
| 82 | RASQNIRNYLN | 288 | GASSLQS | 309 | QQSYSTPLT | 333 |
| 83 | QASLDINNYLN | 289 | KASSLES | 328 | QQSYSMPLT | 395 |
| 84 | QASQDISNYLN | 241 | AASSLQG | 329 | QQSYTTPWT | 396 |
| 85 | QASQDISNYLN | 241 | AASSLQS | 294 | QQSYSSPLT | 397 |
| 86 | QASQDISNYLN | 241 | KASSLES | 328 | QQSYSDPLT | 398 |
| 87 | QASQDISNYLN | 241 | GASTLQS | 316 | QQSYSAPIT | 362 |
| 88 | RASQSISNYLN | 249 | AASNLQS | 330 | QQSYTTPLT | 361 |
| 89 | RASQNIGNYLN | 290 | AASTLQS | 299 | QQSYSTPPWT | 399 |
| 90 | QASQDISNYLN | 241 | AASTLRS | 331 | QQSYQTPLT | 400 |
| 91 | QASQDISNYLN | 241 | AASTLQS | 299 | QQSYTTPPT | 401 |
| 92 | QASQDISNYLN | 241 | AASSLHS | 332 | QQSYSTPQT | 371 |
| 93 | RASQGIRNDLN | 291 | AASNLQS | 330 | QQANSFPIT | 402 |
| 94 | RASQGINTWLA | 292 | AASSLQS | 294 | QQSYSTPYT | 344 |
| 95 | QASQDISNYLN | 241 | AASTLQS | 299 | QQSYTVPPT | 403 |
| 96 | QASQDIRYFLN | 757 | AASTLQS | 299 | QQDDSFPLT | 404 |

TABLE 10

HCDRs using the IMGT Numbering Scheme

| CD8 Binder | H-CDR1 Sequence | SEQ ID NO: | H-CDR2 Sequence | SEQ ID NO: | H-CDR3 Sequence | SEQ ID NO: |
|---|---|---|---|---|---|---|
| 1 | GGTFSSYA | 758 | IDPSDGNT | 817 | AKERAAAGYYYYMDV | 878 |
| 2 | GGTFNTYA | 759 | IDPSSGGT | 818 | AKEHAAGTYYYYMDV | 879 |
| 3 | GGTFSSYA | 758 | IDPSGGNT | 819 | AKERAAAGYYYYMDV | 878 |
| 4 | GYTFTGYY | 760 | INPNNGDT | 820 | AKEGYYYYGMDV | 880 |
| 5 | GYTFTDYY | 761 | INPNSGGT | 821 | AKEGDYYYGMDA | 881 |
| 6 | GYTFTRYD | 762 | INPNDGST | 822 | ARERGGMPDY | 882 |
| 7 | GYTFTSYA | 763 | INPNSGGT | 821 | ARGHGIPKY | 883 |
| 8 | GYTFTSYY | 764 | MNPNSGNT | 823 | ARVRSGSPQH | 884 |
| 9 | GHTFSRHY | 765 | MNPNSGNT | 823 | ARGGPWIVDAFDI | 885 |
| 10 | GYTFTSYG | 766 | ISAHNGVT | 824 | ARGIAVAGTDY | 886 |
| 11 | GGTFSNTD | 767 | INPSGGST | 825 | AREATWGPYYYYMDV | 887 |
| 12 | GYTFTRSY | 768 | ISPYNGNT | 826 | VRNKDGLQH | 888 |
| 13 | GDTFTGYY | 769 | INPNSGDT | 827 | AKDAKRVGYYYYMDV | 889 |
| 14 | GYTFTRYY | 770 | INPNSGGT | 821 | ARLVGGSPDY | 890 |
| 15 | GYTFTNYD | 771 | INPNSGGT | 821 | ARGAMVDY | 891 |

TABLE 10-continued

HCDRs using the IMGT Numbering Scheme

| CD8 Binder | H-CDR1 Sequence | SEQ ID NO: | H-CDR2 Sequence | SEQ ID NO: | H-CDR3 Sequence | SEQ ID NO: |
|---|---|---|---|---|---|---|
| 16 | GGTFSNTD | 767 | INPSDGDT | 828 | ARGNYVGSYYYGMDV | 892 |
| 17 | GYTFTNYY | 772 | INPNSGDT | 827 | ARDSRGDWYFDL | 893 |
| 18 | GYGFTRYS | 773 | IDPSGGST | 829 | TRHGGRGLADY | 894 |
| 19 | GYTFTSRD | 774 | IDPKSGDT | 830 | ARLKELSSILDAFDI | 895 |
| 20 | GYTFTSYD | 775 | INPGAGSS | 831 | ARERFGTGYYYYMDV | 896 |
| 21 | GFTFSNSD | 776 | ISGDGGTT | 832 | ARVIGEMVDDAFDL | 897 |
| 22 | GYTFTGYY | 760 | INPNSGDT | 827 | ARERLFGTYYYYMDV | 898 |
| 23 | GYTFTTYD | 777 | HPIFGTA | 833 | ARADGELTDY | 899 |
| 24 | GFTFSSYT | 778 | I-GTGGGI | 834 | ARHHLPAHYYYYMDV | 900 |
| 25 | GGTFSRYD | 779 | INPNSGDT | 827 | ARDVPAGRYYYYMDV | 901 |
| 26 | GNTFTSYY | 780 | INPSDGST | 835 | AKDRGVGRYYYYMDV | 902 |
| 27 | GGTFSRYA | 781 | INPSDGST | 835 | AKDSRYGRYYYYMDV | 903 |
| 28 | GGTFSNYA | 782 | INPNGGSP | 836 | AKEIVVGPYYYYMDV | 904 |
| 29 | GGTFTRYA | 783 | INPNSGDT | 827 | ARGMVRGPYYYYMDV | 905 |
| 30 | GGTFSSYA | 758 | INPSGGST | 825 | AREGVTGPYYYYMDV | 906 |
| 31 | GGTFSRFD | 784 | INPSDGST | 835 | ARDAAAGTRYYYYYG-MDV | 907 |
| 32 | GGTFSSHA | 785 | INPSGGST | 825 | ARELYSSTYYYYMDV | 908 |
| 33 | GGTFSSYA | 758 | INPNTGGT | 837 | ARALYSGPYYYYMDV | 909 |
| 34 | GFTFSNSD | 776 | ISGSGGST | 838 | AKEHAAGTYYYYMDV | 879 |
| 35 | GGTFGSYG | 786 | ISGYNGDT | 839 | ARDSLVGRYYYYMDV | 910 |
| 36 | GYIFTDYD | 787 | ISADNGNT | 840 | ARRSELDY | 911 |
| 37 | GYTFTSYH | 788 | ISPNSGAT | 841 | ARGDDNDY | 912 |
| 38 | GYTFTSYD | 775 | INPNSGNT | 842 | ARGEEVDY | 913 |
| 39 | GYTFTSYP | 789 | INPSGGST | 825 | ARGRRVPDY | 914 |
| 40 | GYTFTDYY | 761 | INPKSGAT | 843 | ARGKVTTDY | 915 |
| 41 | GFTFSSFE | 790 | ISESGDSS | 844 | ASGRELIEY | 916 |
| 42 | GFTFDDYA | 791 | I-GTGGGT | 845 | ARVYDFPDV | 917 |
| 43 | GYTFTDSY | 792 | MNPSNGDT | 846 | ARSTYSHIDY | 918 |
| 44 | GYTFTNYY | 772 | ISPSDGST | 847 | AREDSSGFDY | 919 |
| 45 | GYTFMNYY | 793 | INPSGGST | 825 | ARDQGGGFDY | 920 |
| 46 | GYTFTSYY | 764 | FDPEDGET | 848 | ARDQGWGMDV | 921 |
| 47 | GYTFTSYY | 764 | INPKSGRT | 849 | ARLTEGIPDY | 922 |
| 48 | GYTLNDYY | 794 | INPGGGST | 850 | ARDRYGPFDY | 923 |
| 49 | GYTFTSYD | 775 | MNPKTGDT | 851 | TRLVAGGAPDY | 924 |
| 50 | GYTFTGYY | 760 | IDPSDGYT | 852 | ARDGFTGDIAY | 925 |
| 51 | GYTFTGYY | 760 | INPNSGGT | 821 | ARVDDSSSPDY | 926 |

TABLE 10-continued

HCDRs using the IMGT Numbering Scheme

| CD8 Binder | H-CDR1 Sequence | SEQ ID NO: | H-CDR2 Sequence | SEQ ID NO: | H-CDR3 Sequence | SEQ ID NO: |
|---|---|---|---|---|---|---|
| 52 | GYTFTGYY | 760 | IMPISGTT | 853 | TTGPDGTEVDY | 927 |
| 52 | GYTFTNHY | 795 | MNPNSGNT | 823 | ASSESGSDLDY | 928 |
| 54 | GYTFTNYY | 772 | MSPTSGDT | 854 | AREVEIEGYMDV | 929 |
| 55 | GYTFTSYY | 764 | INPNSGDT | 827 | AKDLDDDWYMDV | 930 |
| 56 | GYTFTSYY | 764 | IDPSGDIT | 855 | TTDSTTWDAFDI | 931 |
| 57 | GYTFTDYY | 761 | INPNSGGT | 821 | ARVLVGSGSPDY | 932 |
| 58 | GYTFTENE | 796 | IETSGGST | 856 | AREAAAGLDFQH | 933 |
| 59 | GYTFASYD | 797 | INPNSGGT | 821 | ARANSWDAMVIDY | 934 |
| 60 | GFTFSNSD | 776 | ISGSGVTT | 857 | AREHSSSWYTFDY | 935 |
| 61 | GYTFTAYY | 798 | INPNSGGT | 821 | ARDDDSSGYYLDY | 936 |
| 62 | GYTFTNYY | 772 | INPSGGST | 825 | ARASGDYMDLIDY | 937 |
| 63 | GYTFTDYH | 799 | INPDSGGT | 858 | ALVGSSGYLAPTH | 938 |
| 64 | GYPFTDYY | 800 | MNPNSGNT | 823 | ARVRGDGYNLGDY | 939 |
| 65 | GYTFSDYY | 801 | INPNSGGT | 821 | ARDVDTAMGAGDY | 940 |
| 66 | GYTFTDYY | 761 | INPSGGSA | 859 | ARVARWGYGDYPDY | 941 |
| 67 | GDTFTTHD | 802 | ISPSDGST | 847 | ARDRNGDYYYGMDV | 942 |
| 68 | GDTFTNYY | 803 | INPISGGT | 860 | AREGLGSSWYVLDY | 943 |
| 69 | GYTFTSYD | 775 | ISADNGDT | 861 | ARDGSHYGYYGMDV | 944 |
| 70 | GYTFTSYD | 775 | ISPIYGTP | 862 | ASPGPEGYYYGMDV | 945 |
| 71 | GYTFTDNY | 804 | MNPNSGNT | 823 | ASYHWDYGDYRFDY | 946 |
| 72 | GYTFTSYY | 764 | MNPNSGNT | 823 | ARVEIDYGDSPPDY | 947 |
| 73 | GGTSSSYA | 805 | INPSDGDT | 828 | ARGAEWELRYAFDI | 948 |
| 74 | GYTFTTYD | 777 | INPSGGTT | 863 | ARETYYGLYYYGMDV | 949 |
| 75 | GYTFTSYD | 775 | MNPKSGNT | 864 | ARAPSLRGYSYGPDY | 950 |
| 76 | GGTFTSYD | 806 | INPSGGST | 825 | AKDRQERYYYYMDV | 951 |
| 77 | GYTFTSYD | 775 | INPSDGST | 835 | AKDRSYGDYYYGMDV | 952 |
| 78 | GGTFTSYD | 806 | INPGGGNA | 865 | AREVFSENYYYMDV | 953 |
| 79 | GYTFTSYY | 764 | INPSDGST | 835 | AREWDYTHYYYGMDV | 954 |
| 80 | GNTFTSHW | 807 | FDPEDGET | 848 | ARGDSSGYYQYYFDY | 955 |
| 81 | GYTFTSYD | 775 | ITPVFGIA | 866 | ARGSWDSSSWYIPEY | 956 |
| 82 | GFTFSDYD | 808 | INPRGGST | 867 | ASLVWGGAYYYYMDV | 957 |
| 83 | GYTFTSYG | 766 | MNPNNGDT | 868 | TTPVFSGSYYWYFDP | 958 |
| 84 | GYTFTSYD | 775 | INPSGGGT | 869 | TTDQAVAGPYYYGMDV | 959 |
| 85 | GGTFSSYA | 758 | INPGSGNT | 870 | ARDRWLAGPYYYGMDV | 960 |
| 86 | GYMFTGHD | 809 | HPIFGTP | 871 | ARVMGPVDYYYYGMDV | 961 |
| 87 | GYIFSNYD | 810 | INPSDGST | 835 | ARDLGPFGSYYYYMDV | 962 |

TABLE 10-continued

| | HCDRs using the IMGT Numbering Scheme | | | | | |
|---|---|---|---|---|---|---|
| | H-CDR1 | | H-CDR2 | | H-CDR3 | |
| CD8 Binder | Sequence | SEQ ID NO: | Sequence | SEQ ID NO: | Sequence | SEQ ID NO: |
| 88 | GFTFSSYA | 811 | INGDGDDT | 872 | AREGVVVPPYYYYMDV | 963 |
| 89 | GYTFTTYY | 812 | IDPNSGDT | 873 | ARSSGWSRYYYYYMDV | 964 |
| 90 | GSTFTNYQ | 813 | INPSGGST | 825 | ARDNGMTTGYYYYMDV | 965 |
| 91 | GYTFTSYD | 775 | INPSGGST | 825 | ARDRAMVTGYYYGMDV | 966 |
| 92 | GYTFTSYD | 775 | VNPSDGNT | 874 | ARDRGYGDRGYYYG-MDV | 967 |
| 93 | GGTLSSYD | 814 | INTYNGNT | 875 | ATSPKATADYYYYMDV | 968 |
| 94 | GYTFTSYD | 775 | INPSDGIT | 876 | TTSTVTPSYYYYGMDV | 969 |
| 95 | GYTFTSHA | 815 | INPRDGDT | 877 | AREPVAGTGYYYYYG-MDV | 970 |
| 96 | GGTFNSYG | 816 | MNPNSGNT | 823 | ARDNLAGFWSDYYYYG-MDV | 971 |
| 97 | GRTFSGYV | 1066 | ISRGGLST | 1067 | AADRSDLYEITAASNIDS | 1068 |

TABLE 11

| | LCDRs using the IMGT Numbering Scheme | | | | | |
|---|---|---|---|---|---|---|
| | L-CDR1 | | L-CDR2 | | L-CDR3 | |
| CD8 Binder | Sequence | SEQ ID NO: | Sequence | SEQ ID NO: | Sequence | SEQ ID NO: |
| 1 | QSISSY | 972 | AAS | 1021 | QQSYSTPLT | 333 |
| 2 | QDISNY | 973 | AAS | 1021 | QQSYSNLVS | 334 |
| 3 | QSISSY | 972 | AAS | 1021 | QQSYSTPLT | 333 |
| 4 | QSLLHSNGYNY | 974 | LGS | 1022 | MQALQTPFT | 335 |
| 5 | QSLLHSNGYNY | 974 | LGS | 1022 | MQGLQTPHT | 336 |
| 6 | QSISRN | 975 | KAS | 1023 | QQTYSAPL | 337 |
| 7 | QSLLHSNGYNY | 974 | LGS | 1022 | MQTLQTPLT | 338 |
| 8 | QSVSASD | 976 | GAS | 1024 | QQYGDSPGS | 339 |
| 9 | QDIGNY | 977 | AAS | 1021 | QQANSFPPT | 340 |
| 10 | QSISTH | 978 | GAS | 1024 | QQYGNSRT | 341 |
| 11 | QTISNY | 979 | AAS | 1021 | QQSYSTPPT | 342 |
| 12 | QGIRND | 980 | DAS | 1025 | QQSYSSPYT | 343 |
| 13 | QSISNY | 981 | AAS | 1021 | QQSYSTPYT | 344 |
| 14 | QSLLHSNGYNY | 974 | LGS | 1022 | MQGAHWPPT | 345 |
| 15 | QGISDS | 982 | GAS | 1024 | QQSYRTPYT | 346 |
| 16 | QSISNY | 981 | AAS | 1021 | QESFTTQWT | 347 |
| 17 | QDIHNY | 983 | DAS | 1025 | QQANSFPPT | 340 |
| 18 | QDISNY | 973 | SAS | 1026 | QQRSNWPLYT | 348 |
| 19 | QSISDW | 984 | AAS | 1021 | QQAISFPIT | 349 |
| 20 | QDISNY | 973 | SAS | 1026 | QQSYSSPFT | 350 |
| 21 | QSISTW | 985 | AAS | 1021 | QQAISFPLT | 351 |
| 22 | QSISNY | 981 | AAS | 1021 | QQSYTFPIT | 352 |
| 23 | QSLLHSNGYNY | 974 | DAS | 1025 | QQYYSYPPT | 353 |
| 24 | QDISNY | 973 | AAS | 1021 | QQSYSAPLT | 354 |
| 25 | QDISNY | 973 | AAS | 1021 | QQSFSTFYT | 355 |
| 26 | QDISNY | 973 | AAS | 1021 | QQSYSIPFT | 356 |
| 27 | QSINRF | 986 | AAS | 1021 | QQSYSTPYT | 344 |
| 28 | QSISSY | 972 | AAS | 1021 | QQSYSTPLT | 333 |
| 29 | QDISNY | 973 | AAS | 1021 | QQSYSTPIT | 357 |
| 30 | QSVSTY | 987 | AAS | 1021 | QQSYTIPST | 358 |
| 31 | QDIAKY | 988 | AAS | 1021 | QQSYSAPPT | 359 |
| 32 | QGITNY | 989 | GAS | 1024 | QQSYSTPWT | 360 |
| 33 | QSISSY | 972 | AAS | 1021 | QQSYSTPLT | 333 |
| 34 | QDIHNY | 983 | AAS | 1021 | QQSYTTPLT | 361 |
| 35 | QDISNY | 973 | SAF | 1027 | QQSYSAPIT | 362 |
| 36 | QSISSY | 972 | SAS | 1026 | QQRSNWPPVT | 363 |

TABLE 11-continued

LCDRs using the IMGT Numbering Scheme

| CD8 Binder | L-CDR1 Sequence | SEQ ID NO: | L-CDR2 Sequence | SEQ ID NO: | L-CDR3 Sequence | SEQ ID NO: |
|---|---|---|---|---|---|---|
| 37 | QDISNF | 990 | DAS | 1025 | QQSYSIPIT | 364 |
| 38 | QGISNN | 991 | EAS | 1028 | QQSYSTPLT | 333 |
| 39 | QSLLHSNGYNY | 974 | GAS | 1024 | MQGLQPPGT | 365 |
| 40 | QSISRS | 992 | AAS | 1021 | QQSYNHFRT | 366 |
| 41 | QDISNY | 973 | DAS | 1025 | QRSDSTPLT | 367 |
| 42 | HDISKS | 993 | GAS | 1024 | QQLNSYPRT | 368 |
| 43 | QDIGAY | 994 | AAS | 1021 | QQSYSIPYT | 369 |
| 44 | QSISSY | 972 | AAS | 1021 | QQSYSTPYT | 344 |
| 45 | QGIRSY | 995 | GAS | 1024 | QQSYSTPYT | 344 |
| 46 | QSISSY | 972 | AAS | 1021 | QQTYSTPYT | 370 |
| 47 | QNIGTW | 996 | AAS | 1021 | QQSYSTPQT | 371 |
| 48 | QTISYY | 997 | AAS | 1021 | QQSYRTPYT | 346 |
| 49 | QSLLHSNGYNY | 974 | MGS | 1029 | MQGTHWPT | 372 |
| 50 | QNINNY | 998 | GAS | 1024 | QQTFSLPYT | 373 |
| 51 | QTISTY | 999 | DAS | 1025 | QQSYSTPYT | 344 |
| 52 | RGIGND | 1000 | DAS | 1025 | QQGYNMPLT | 374 |
| 52 | QTIGNY | 1001 | GAS | 1024 | QQTYSAPLT | 375 |
| 54 | QFIGSW | 1002 | AAS | 1021 | QQSYSFPWT | 376 |
| 55 | QSISSW | 1003 | DAS | 1025 | QQTYSTPYI | 377 |
| 56 | QGISNN | 991 | DAS | 1025 | QQSYSSPWT | 378 |
| 57 | QSVLYSSNNKNY | 1004 | WAS | 1030 | QQYASAPRT | 379 |
| 58 | QSISSY | 972 | KTS | 1031 | QQSFTIPYT | 380 |
| 59 | QGISSY | 1005 | GAS | 1024 | QQSYSTPLT | 333 |
| 60 | QSISDW | 984 | DAS | 1025 | QQSYSTPLT | 333 |
| 61 | QGISNY | 1006 | SAS | 1026 | QQTYRTPPT | 381 |
| 62 | QSIRNY | 1007 | SAS | 1026 | QQSYSTPLT | 333 |
| 63 | QNIRLY | 1008 | AAS | 1021 | QQSLTTPFT | 382 |
| 64 | QDIRKF | 1009 | AAS | 1021 | QQLNGYPGT | 383 |
| 65 | QSISSY | 972 | TAS | 1032 | QQSYSLPLT | 384 |
| 66 | QDISNY | 973 | DAS | 1025 | QQTYTTPRT | 385 |
| 67 | QNVRSW | 1010 | AAS | 1021 | QQSYNTPYT | 386 |
| 68 | QGIGND | 1011 | AAS | 1021 | QQSYAPPPT | 387 |
| 69 | QSISNW | 1012 | GAS | 1024 | QQSYSTPPT | 342 |
| 70 | QSLLHSNGYNY | 974 | LGS | 1022 | MQGLQTPLT | 388 |
| 71 | QSISSY | 972 | LAS | 1033 | QQSDSIPVT | 389 |
| 72 | QDISNY | 973 | STS | 1034 | QQSYSTPYN | 390 |
| 73 | ESIGSW | 1013 | AAS | 1021 | QQSYSTPYT | 344 |
| 74 | QSISNY | 981 | AAS | 1021 | QQSYSTPLT | 333 |
| 75 | QSVTSNY | 1014 | GAS | 1024 | QHYGSSPA | 391 |
| 76 | QSISSY | 972 | AAS | 1021 | QQSYSTPLT | 333 |
| 77 | QGISSY | 1005 | AAS | 1021 | QQSYSTPPT | 342 |
| 78 | QDIGNY | 977 | AAS | 1021 | QQAYTYPYT | 392 |
| 79 | QDISNY | 973 | GAS | 1024 | QQSYTTPNT | 393 |
| 80 | QGISNY | 1006 | AAS | 1021 | QQSYSTPYT | 344 |
| 81 | QGISNG | 1015 | DAS | 1025 | QQSYSTPFT | 394 |
| 82 | QNIRNY | 1016 | GAS | 1024 | QQSYSTPLT | 333 |
| 83 | LDINNY | 1017 | KAS | 1023 | QQSYSMPLT | 395 |
| 84 | QDISNY | 973 | AAS | 1021 | QQSYTTPWT | 396 |
| 85 | QDISNY | 973 | AAS | 1021 | QQSYSSPLT | 397 |
| 86 | QDISNY | 973 | KAS | 1023 | QQSYSDPLT | 398 |
| 87 | QDISNY | 973 | GAS | 1024 | QQSYSAPIT | 362 |
| 88 | QSISNY | 981 | AAS | 1021 | QQSYTTPLT | 361 |
| 89 | QNIGNY | 1018 | AAS | 1021 | QQSYSTPPWT | 399 |
| 90 | QDISNY | 973 | AAS | 1021 | QQSYQTPLT | 400 |
| 91 | QDISNY | 973 | AAS | 1021 | QQSYTTPPT | 401 |
| 92 | QDISNY | 973 | AAS | 1021 | QQSYSTPQT | 371 |
| 93 | QGIRND | 980 | AAS | 1021 | QQANSFPIT | 402 |
| 94 | QGINTW | 1019 | AAS | 1021 | QQSYSTPYT | 344 |
| 95 | QDISNY | 973 | AAS | 1021 | QQSYTVPPT | 403 |
| 96 | QDIRYF | 1020 | AAS | 1021 | QQDDSFPLT | 404 |

TABLE 12

| CD8 Binder Variant | Full Binder Sequence | SEQ ID NO: |
|---|---|---|
| 98 | QVQLVQSGAEVKKPGASVKVSCKASGGTFSSYAISWVRQAPGQGLEWMGIIDPSDGNTNYA-QNFQGRVTMTRDTSTSTVYMELSSLRSEDTAVYYCAKERAAAGYYYYMDVWGQGTTVTVSSGGGGSGGGGSGGGGSDIQMTQSPSSLSASVGDRVTITCRASQSISSYLNWYQQKPGKAPKLLIYAAS-SLQSGVPSRFSGSGSGTDFTLTISSLQPEDFATYYCQQSYSTPLTFGGGTKVEIKR | 1035 |

TABLE 12-continued

| CD8 Binder Variant | Full Binder Sequence | SEQ ID NO: |
|---|---|---|
| 99 | DIQMTQSPSSLSASVGDRVTITCRASQSIS SYLNWYQQKPGKAPKLLIYAAS-SLQSGVP SRFSGSGSGTDFTLTISSLQPEDFATYYCQ QSYSTPLTFGGGTKVEIKRGGGGSGGGGS GGGSQVQLVQSGAEVKKPGASVKVSCKASG GTFSSYAISWVRQAPGQGLEWMGI-IDPSD GNTNYAQNFQGRVTMTRDTSTSTVYMELSS LRSEDTAVYYCAKERAAAGYYYYMDVWGQG TTVTVSS | 1036 |
| 100 | QVQLVQSGAEVKKPGASVKVSCKASGGTFS SYAISWVRQAPGQCLEWMGIIDPSDGNTNY A-QNFQGRVTMTRDTSTSTVYMELSSLRSE DTAVYYCAKERAAAGYYYYMDVWGQGTTVT VSSGGGGSGGGGSGGGGSDIQMTQSPSSLS ASVGDRVTITCRASQSISSYLNWYQQKPGK APKLLIYAAS-SLQSGVPSRFSGSGSGTDFT LTISSLQPEDFATYYCQQSYSTPLTFGCGT KVEIKR | 1037 |
| 101 | DIQMTQSPSSLSASVGDRVTITCRASQSIS SYLNWYQQKPGKAPKLLIYAAS-SLQSGVP SRFSGSGSGTDFTLTISSLQPEDFATYYCQ QSYSTPLTFGCGTKVEIKRGGGGSGGGGS GGGSQVQLVQSGAEVKKPGASVKVSCKASG GTFSSYAISWVRQAPGQCLEWMGIIDPSDG NTNYA-QNFQGRVTMTRDTSTSTVYMELSS LRSEDTAVYYCAKERAAAGYYYYMDVWGQG TTVTVSS | 1038 |
| 102 | QVQLVQSGAEVKKPGASVKVSCKASGGTFS SYAISWVRQAPGQCLEWMGIIDPSDGNTNY A-QNFQGRVTMTRDTSTSTVYMELSSLRSE DTAVYYCAKERAAAGYYYYMDVWGQGTTVT VSSGGGGSGGGGSGGGGSDIQMTQSPSSLS ASVGDRVTITCRASQSISSYLNWYQQKPGK APKLLIYAAS-SLQSGVPSRFSGSGSGTDFT LTISSLQPEDFATYYCQQSYSTPLTFGCGT KVEIKR | 1037 |
| 103 | DIQMTQSPSSLSASVGDRVTITCRASQSIS SYLNWYQQKPGKAPKLLIYAAS-SLQSGVP SRFSGSGSGTDFTLTISSLQPEDFATYYCQ QSYSTPLTFGCGTKVEIKRGGGGSGGGGS GGGSQVQLVQSGAEVKKPGASVKVSCKASG GTFSSYAISWVRQAPGQCLEWMGIIDPSDG NTNYA-QNFQGRVTMTRDTSTSTVYMELSS LRSEDTAVYYCAKERAAAGYYYYMDVWGQG TTVTVSS | 1038 |
| 104 | DIVMTQSPLSLPVTPGEPASISCRSSQSLL HSNGYNYLDWYLQKPGQSPQLLIYL-GSNR ASGVPDRFSGSGSGTDFTLKISRVEAEDVG VYYCMQGLQTPHTFGQGTKVEIKRGGGGSG GGGSGGGGSQVQLVQSGAEVKKPGASVKVS CKASGYTFTDYYIQWVRQAPGQGLEW-MGW INPNSGGTSYAQKFQGRVTMTRDTSTSTVY MELSSLRSEDTAVYYCAKEGDYYYGMDAWG QGTMVTVSS | 1039 |
| 105 | QVQLVQSGAEVKKPGASVKVSCKASGYTFT DYYIQWVRQAPGQGLEWMGWINPNSGGTSY A-QKFQGRVTMTRDTSTSTVYMELSSLRSE DTAVYYCAKEGDYYYGMDAWGQGTMVTVSS GGGGSGGGGSGGGGSDIVMTQSPLSLPVTP GEPASISCRSSQSLLHSNGYNYLDWYLQKP GQSPQLLI-YLGSNRASGVPDRFSGSGSGT DFTLKISRVEAEDVGVYYCMQGLQTPHTFG QGTKVEIKR | 1040 |
| 106 | DIVMTQSPLSLPVTPGEPASISCRSSQSLL HSNGYNYLDWYLQKPGQSPQLLIYL-GSNR ASGVPDRFSGSGSGTDFTLKISRVEAEDVG VYYCMQGLQTPHTFGQGTKVEIKRGGGGSG GGGSGGGGSQVQLVQSGAEVKKPGASVKVS CKASGYTFTDYYIQWVRQAPGQGLEW-MGW INPNSGGTSYAQKFQGRVTMTRDTSTSTVY MELSSLRSEDTAVYYCAKEGDYYYGMDAWG QGTMVTVSS | 1039 |
| 107 | QVQLVQSGAEVKKPGASVKVSCKASGYTFT DYYIQWVRQAPGQCLEWMGWINPNSGGTSY A-QKFQGRVTMTRDTSTSTVYMELSSLRSE DTAVYYCAKEGDYYYGMDAWGQGTMVTVSS GGGGSGGGGSGGGGSDIQMTQSPLSLPVTP GEPASISCRSSQSLLHSNGYNYLDWYLQKP GQSPQLLI-YLGSNRASGVPDRFSGSGSGT DFTLKISRVEAEDVGVYYCMQGLQTPHTFG CGTKVEIKR | 1041 |
| 108 | DIVMTQSPLSLPVTPGEPASISCRSSQSLL HSNGYNYLDWYLQKPGQSPQLLIYL-GSNR ASGVPDRFSGSGSGTDFTLKISRVEAEDVG VYYCMQGLQTPHTFGCGTKVEIKRGGGGSG GGGSGGGGSQVQLVQSGAEVKKPGASVKVS CKASGYTFTDYYIQWVRQAPGQCLEW-MGW INPNSGGTSYAQKFQGRVTMTRDTSTSTVY MELSSLRSEDTAVYYCAKEGDYYYGMDAWG QGTMVTVSS | 1042 |
| 109 | QVQLVQSGAEVKKPGASVKVSCKASGYTFT DYYIQWVRQAPGQCLEWMGWINPNSGGTSY A-QKFQGRVTMTRDTSTSTVYMELSSLRSE DTAVYYCAKEGDYYYGMDAWGQGTMVTVSS GGGGSGGGGSGGGGSDIVMTQSPLSLPVTP GEPASISCRSSQSLLHSNGYNYLDWYLQKP GQSPQLLI-YLGSNRASGVPDRFSGSGSGT DFTLKISRVEAEDVGVYYCMQGLQTPHTFG CGTKVEIKR | 1041 |
| 110 | DIVMTQSPLSLPVTPGEPASISCRSSQSLL HSNGYNYLDWYLQKPGQSPQLLIYL-GSNR ASGVPDRFSGSGSGTDFTLKISRVEAEDVG VYYCMQGLQTPHTFGCGTKVEIKRGGGGSG GGGSGGGGSQVQLVQSGAEVKKPGASVKVS CKASGYTFTDYYIQWVRQAPGQCLEW-MGW INPNSGGTSYAQKFQGRVTMTRDTSTSTVY MELSSLRSEDTAVYYCAKEGDYYYGMDAWG QGTMVTVSS | 1042 |
| 111 | QVQLVQSGAEVKKPGASVKVSCKASGYTFT SYYMHWVRQAPGQCLEWMGGFDPEDGETIY A-QKFQGRVTMTRDTSTSTVYMELSSLRSE DTAVYYCARDQGWGMDVWGQGTTVTVSSGG GGSGGGGSGGGGSDIQMTQSPSSLSASVGD RVTITCRASQSISSYLNWYQQKPGKAPKLL IYAAS-SLQSGVPSRFSGSGSGTDFTLTIS SLQPEDFATYYCQQTYSTPYTFGCGTKLEI KR | 1043 |
| 112 | QVQLVQSGAEVKKPGASVKVSCKASGYTFT SYYMHWVRQAPGQCLEWMGGFDPEDGETIY A-QKFQGRVTMTRDTSTSTVYMELSSLRSE DTAVYYCARDQGWGMDVWGQGTTVTVSSGG GGSGGGGSGGGGSDIQMTQSPSSLSASVGD RVTITCRASQSISSYLNWYQQKPGKAPKLL IYAAS-SLQSGVPSRFSGSGSGTDFTLTIS SLQPEDFATYYCQQTYSTPYTFGCGTKLEI KR | 1043 |
| 113 | QVQLVQSGAEVKKPGASVKVSCKASGYTFT SYYMHWVRQAPGQCLEWMGGFDPEDGETIY A-QKFQGRVTMTRDTSTSTVYMELSSLRSE DTAVYYCARDQGWGMDVWGQGTTVTVSSGG GGSGGGGSGGGGSDIQMTQSPSSLSASVGD RVTITCRASQSISSYLNWYQQKPGKAPKLL IYAAS-SLQSGVPSRFSGSGSGTDFTLTIS SLQPEDFATYYCQQTYSTPYTFGQGTKLEI KR | 1044 |

TABLE 12-continued

| CD8 Binder Variant | Full Binder Sequence | SEQ ID NO: |
|---|---|---|
| 114 | DIQMTQSPSSLSASVGDRVTITCRASQSIS SYLNWYQQKPGKAPKLLIYAAS-SLQSGVP SRFSGSGSGTDFTLTISSLQPEDFATYYCQ QTYSTPYTFGCGTKLEIKRGGGGSGGGGSG GGGSQVQLVQSGAEVKKPGASVKVSCKASG YTFTSYYMHWVRQAPGQCLEWMGGFDPEDG ETIYA-QKFQGRVTMTRDTSTSTVYMELSS LRSEDTAVYYCARDQGWGMDVWGQGTTVTV SS | 1045 |
| 115 | DIQMTQSPSSLSASVGDRVTITCRASQSIS SYLNWYQQKPGKAPKLLIYAAS-SLQSGVP SRFSGSGSGTDFTLTISSLQPEDFATYYCQ QTYSTPYTFGCGTKLEIKRGGGGSGGGGSG GGGSQVQLVQSGAEVKKPGASVKVSCKASG YTFTSYYMHWVRQAPGQCLEWMGGFDPEDG ETIYA-QKFQGRVTMTRDTSTSTVYMELSS LRSEDTAVYYCARDQGWGMDVWGQGTTVTV SS | 1045 |
| 116 | DIQMTQSPSSLSASVGDRVTITCRASQSIS SYLNWYQQKPGKAPKLLIYAAS-SLQSGVP SRFSGSGSGTDFTLTISSLQPEDFATYYCQ QTYSTPYTFGQGTKLEIKRGGGGSGGGGSG GGGSQVQLVQSGAEVKKPGASVKVSCKASG YTFTSYYMHWVRQAPGQGLEWMGGFDPEDG -ETIYAQKFQGRVTMTRDTSTSTVYMELSSL RSEDTAVYYCARDQGWGMDVWGQGTTVTVS S | 1046 |
| 117 | DIQMTQSPSSLSASVGDRVTITCRASQTIG NYVNWYQQKPGKAPKLLI-YGASNLHTGVP SRFSGSGSGTDFTLTISSLQPEDFATYYCQ QTYSAPLTFGGGTKVEIKRGGGGSGGGGSG GGGSQVQLVQSGAEVKKPGASVKVSCKASG YTFTNHYMHWVRQAPGQGLEW-MGWMNPNS GNTGYAQKFQGRVTMTRDTSTSTVYMELSS LRSEDTAVYYCASSESGSDLDYWGQGTLVT VSS | 1047 |
| 118 | QVQLVQSGAEVKKPGASVKVSCKASGYTFT NHYMHWVRQAPGQGLEWMGWMNPNSGNTGY A-QKFQGRVTMTRDTSTSTVYMELSSLRSE DTAVYYCASSESGSDLDYWGQGTLVTVSSG GGGSGGGGSGGGGSDIQMTQSPSSLSASVG DRVTITCRASQTIGNYVNWYQQKPGKAPKL LI-YGASNLHTGVPSRFSGSGSGTDFTLTI SSLQPEDFATYYCQQTYSAPLTFGGGTKVE IKR | 1048 |
| 119 | DIQMTQSPSSLSASVGDRVTITCRASQTIG NYVNWYQQKPGKAPKLLI-YGASNLHTGVP SRFSGSGSGTDFTLTISSLQPEDFATYYCQ QTYSAPLTFGGGTKVEIKRGGGGSGGGGSG GGGSQVQLVQSGAEVKKPGASVKVSCKASG YTFTNHYMHWVRQAPGQGLEW-MGWMNPNS GNTGYAQKFQGRVTMTRDTSTSTVYMELSS LRSEDTAVYYCASSESGSDLDYWGQGTLVT VSS | 1047 |
| 120 | QVQLVQSGAEVKKPGASVKVSCKASGYTFT NHYMHWVRQAPGQCLEWMGWMNPNSGNTGY A-QKFQGRVTMTRDTSTSTVYMELSSLRSE DTAVYYCASSESGSDLDYWGQGTLVTVSSG GGGSGGGGSGGGGSDIQMTQSPSSLSASVG DRVTITCRASQTIGNYVNWYQQKPGKAPKL LI-YGASNLHTGVPSRFSGSGSGTDFTLTI SSLQPEDFATYYCQQTYSAPLTFGCGTKVE IKR | 1049 |
| 121 | DIQMTQSPSSLSASVGDRVTITCRASQTIG NYVNWYQQKPGKAPKLLI-YGASNLHTGVPS RFSGSGSGTDFTLTISSLQPEDFATYYCQQ TYSAPLTFGCGTKVEIKRGGGGSGGGGSGG GGSQVQLVQSGAEVKKPGASVKVSCKASGY TFTNHYMHWVRQAPGQCLEW-MGWMNPNSG | 1050 |

TABLE 12-continued

| CD8 Binder Variant | Full Binder Sequence | SEQ ID NO: |
|---|---|---|
|  | NTGYAQKFQGRVTMTRDTSTSTVYMELSSL RSEDTAVYYCASSESGSDLDYWGQGTLVTV SS |  |
| 122 | QVQLVQSGAEVKKPGASVKVSCKASGYTFT NHYMHWVRQAPGQCLEWMGWMNPNSGNTGY A-QKFQGRVTMTRDTSTSTVYMELSSLRSE DTAVYYCASSESGSDLDYWGQGTLVTVSSG GGGSGGGGSGGGGSDIQMTQSPSSLSASVG DRVTITCRASQTIGNYVNWYQQKPGKAPKL LI-YGASNLHTGVPSRFSGSGSGTDFTLTI SSLQPEDFATYYCQQTYSAPLTFGCGTKVE IKR | 1049 |
| 123 | DIQMTQSPSSLSASVGDRVTITCRASQTIG NYVNWYQQKPGKAPKLLI-YGASNLHTGVP SRFSGSGSGTDFTLTISSLQPEDFATYYCQ QTYSAPLTFGCGTKVEIKRGGGGSGGGGSG GGGSQVQLVQSGAEVKKPGASVKVSCKASG YTFTNHYMHWVRQAPGQCLEW-MGWMNPNS GNTGYAQKFQGRVTMTRDTSTSTVYMELSS LRSEDTAVYYCASSESGSDLDYWGQGTLVT VSS | 1050 |
| 124 | QVQLVQSGAEVKKPGASVKVSCKASGYTFT NHYMFIWVRQAPGQGLEWMGIINPNSGNTG YA-QKFQGRVTMTRDTSTSTVYMELSSLRS EDTAVYYCASSESGSDLDYWGQGTLVTVSS GGGGSGGGGSGGGGSDIQMTQSPSSLSASV GDRVTITCRASQTIGNYVNWYQQKPGKAPK LLI-YGASNLHTGVPSRFSGSGSGTDFTLT ISSLQPEDFATYYCQQTYSAPLTFGGGTKV EIKR | 1051 |
| 125 | DIQMTQSPSSLSASVGDRVTITCRASQTIG NYVNWYQQKPGKAPKLLI-YGASNLHTGVP SRFSGSGSGTDFTLTISSLQPEDFATYYCQ QTYSAPLTFGGGTKVEIKRGGGGSGGGGSG GGGSQVQLVQSGAEVKKPGASVKVSCKASG YTFTNHYMHWVRQAPGQGLEWMGI-INPNS GNTGYAQKFQGRVTMTRDTSTSTVYMELSS LRSEDTAVYYCASSESGSDLDYWGQGTLVT VSS | 1052 |
| 126 | QVQLVQSGAEVKKPGASVKVSCKASGYTFT NHYMHWVRQAPGQGLEWMGIINPNSGNTGY A-QKFQGRVTMTRDTSTSTVYMELSSLRSE DTAVYYCASSESGSDLDYWGQGTLVTVSSG GGGSGGGGSGGGGSDIQMTQSPSSLSASVG DRVTITCRASQTIGNYVNWYQQKPGKAPKL LI-YGASNLHTGVPSRFSGSGSGTDFTLTI SSLQPEDFATYYCQQTYSAPLTFGGGTKVE IKR | 1051 |
| 127 | DIQMTQSPSSLSASVGDRVTITCRASQTIG NYVNWYQQKPGKAPKLLI-YGASNLHTGVP SRFSGSGSGTDFTLTISSLQPEDFATYYCQ QTYSAPLTFGGGTKVEIKRGGGGSGGGGSG GGGSQVQLVQSGAEVKKPGASVKVSCKASG YTFTNHYMHWVRQAPGQGLEWMGI-INPNS GNTGYAQKFQGRVTMTRDTSTSTVYMELSS LRSEDTAVYYCASSESGSDLDYWGQGTLVT VSS | 1052 |
| 128 | QVQLVESGGGLVQAGGSLRLSCAASGRTFS GYVMGWFRQAPGKQRKFVAAISRG-GLSTS YADSVKGRFTISRDNAKNTVFLQMNTLKPE DTAVYYCAADRSDLYEITAASNIDSWGQGT LVTVSS | 1060 |

TABLE 13

| CD8 Fusion Proteins | Full Fusion Protein Sequence | SEQ ID NO: |
|---|---|---|
| NivG.002_1 | MKKINEGLLDSKILSAFNTVIALLGSIVII VMNIMIIQNYTRSTDNQAVIKDAL-QGIQQ QIKGLADKIGTEIGPKVSLIDTSSTITIPA NIGLLGSKISQSTASINENVNEKCKFTLPP LKIHECNISCPNPLPFREYRPQTEGVSNLV GLPNNICLQKTSNQILKPK-LISYTLPWGQ SGTCITDPLLAMDEGYFAYSHLERIGSCSR GVSKQRIIGVGEVLDRGDEVPSLFMTNVWT PPNPNTVYHCSAVYNNEFYYVLCAVSTVGD PILNSTYWSGSLMMTRLAVKPK-SNGGGYN QHQLALRSIEKGRYDKVMPYGPSGIKQGDT LYFPAVGFLVRTEFKYNDSNCPITKCQYSK PENCRLSMGIRPNSHYILRSGLLKYNLSDG ENPKWFIEISDQRLSIG-SPSKIYDSLGQP VFYQASFSWDTMIKFGDVLTVNPLVVNWRN NTVISRPGQSQCPRFNTCPAICAEGVYNDA FLIDRINWISAGVFLDSNATAANPVFTVFK DNEILYRAQLASEDTNAQKTITNCFLLK-N KIWCISLVEIYDTGDNVIRPKLFAVKIPEQ CTGGGGSGGGGSGGGGSQVQLVQSGAEVKK PGASVKVSCKASGGTFSSYAISWVRQAPGQ GLEWMGIIDPSDGNTNYA-QNFQGRVTM TABLE 13-continued

| CD8 Fusion Proteins | Full Fusion Protein Sequence | SEQ ID NO: |
|---|---|---|
| | LYFPAVGFLVRTEFKYNDSNCPITKCQYSK PENCRLSMGIRPNSHYILRSGLLKYNLSDG ENPKWFIEISDQRLSIG-SPSKIYDSLGQP VFYQASFSWDTMIKFGDVLTVNPLWNWRNN TVISRPGQSQCPRFNTCPAICAEGVYNDAF LIDRINWISAGVFLDSNATAANPVFTVFKD NEILYRAQLASEDTNAQKTITNCFLLK-NK IWCISLVEIYDTGDNVIRPKLFAVKIPEQC TGGGGSGGGGSGGGGSQVQLVQSGAEVKKP GASVKVSCKASGGTFSSYAISWVRQAPGQG LEWMGIIDPSDGNTNYA-QNFQGRVTMTRD TSTSTVYMELSSLRSEDTAVYYCAKERAAA GYYYYMDVWGQGTTVTVSSGGGGSGGGGSG GGGSDIQMTQSPSSLSASVGDRVTITCRAS QSISSYLNWYQQKPGKAPKLLIYAAS-SLQ SGVPSRFSGSGSGTDFTLTISSLQPEDFAT YYCQQSYSTPLTFGGGTKVEIKR | |
| NivG.002_5_2 | KKINEGLLDSKILSAFNTVIALLGSIVIIV MNIMIIQNYTRSTDNQAVIKDAL-QGIQQQ IKGLADKIGTEIGPKVSLIDTSSTITIPAN IGLLGSKISQSTASINENVNEKCKFTLPPL KIHECNISCPNPLPFREYRPQTEGVSNLVG LPNNICLQKTSNQILKPK-LISYTLPVVGQ SGTCITDPLLAMDEGYFAYSHLERIGSCSR GVSKQRIIGVGEVLDRGDEVPSLFMTNVWT PPNPNTVYHCSAVYNNEFYYVLCAVSTVGD PILNSTYWSGSLMMTRLAVKPK-SNGGGYN QHQLALRSIEKGRYDKVMPYGPSGIKQGDT LYFPAVGFLVRTEFKYNDSNCPITKCQYSK PENCRLSMGIRPNSHYILRSGLLKYNLSDG ENPKWFIEISDQRLSIG-SPSKIYDSLGQP VFYQASFSWDTMIKFGDVLTVNPLVVNWRN NTVISRPGQSQCPRFNTCPAICAEGVYNDA FLIDRINWISAGVFLDSNATAANPVFTVFK DNEILYRAQLASEDTNAQKTITNCFLLK-N KIWCISLVEIYDTGDNVIRPKLFAVKIPEQ CTGGGGSGGGGSGGGGSQVQLVQSGAEVKK PGASVKVSCKASGYTFTDYYIQWVRQAPGQ GLEWMGWINPNSGGTSYA-QKFQGRVTMTR DTSTSTVYMELSSLRSEDTAVYYCAKEGDY YYGMDAWGQGTMVTVSSGGGGSGGGGSGGG GSDIVMTQSPLSLPVTPGEPASISCRSSQS LLHSNGYNYLDWYLQKPGQSPQLLIYL-GS NRASGVPDRFSGSGSGTDFTLKISRVEAED VGVYYCMQGLQTPHTFGQGTKVEIKR | 1071 |
| NivG.002_46_2 | KKINEGLLDSKILSAFNTVIALLGSIVIIV MNIMIIQNYTRSTDNQAVIKDAL-QGIQQQ IKGLADKIGTEIGPKVSLIDTSSTITIPAN IGLLGSKISQSTASINENVNEKCKFTLPPL KIHECNISCPNPLPFREYRPQTEGVSNLVG LPNNICLQKTSNQILKPK-LISYTLPVVGQ SGTCITDPLLAMDEGYFAYSFILERIGSCS RGVSKQRIIGVGEVLDRGDEVPSLFMTNVW TPPNPNTVYHCSAVYNNEFYYVLCAVSTVG DPILNSTYWSGSLMMTRLAVKPK-SNGGGY NQHQLALRSIEKGRYDKVMPYGPSGIKQGD TLYFPAVGFLVRTEFKYNDSNCPITKCQYS KPENCRLSMGIRPNSHYILRSGLLKYNLSD GENPKWFIEISDQRLSIG-SPSKIYDSLGQ PVFYQASFSWDTMIKFGDVLTVNPLVVNWR NNTVISRPGQSQCPRFNTCPAICAEGVYND AFLIDRINWISAGVFLDSNATAANPVFTVF KDNEILYRAQLASEDTNAQKTITNCFLLK- NKIWCISLVEIYDTGDNVIRPKLFAVKIPE QCTGGGGSGGGGSGGGGSQVQLVQSGAEVK KPGASVKVSCKASGYTFTSYYMFIWVRQAP GQGLEWMGGFDPEDGETIYA-QKFQGRVTM TRDTSTSTVYMELSSLRSEDTAVYYCARDQ GWGMDVWGQGTTVTVSSGGGGSGGGGSGGG GSDIQMTQSPSSLSASVGDRVTITCRASQS ISSYLNWYQQKPGKAPKLLIYAAS-SLQSG VPSRFSGSGSGTDFTLTISSLQPEDFATYY CQQTYSTPYTFGQGTKLEIKR | 1072 |
| NivG.002_52_2 | KKINEGLLDSKILSAFNTVIALLGSIVIIV MNIMIIQNYTRSTDNQAVIKDAL-QGIQQQ IKGLADKIGTEIGPKVSLIDTSSTITIPAN IGLLGSKISQSTASINENVNEKCKFTLPPL KIHECNISCPNPLPFREYRPQTEGVSNLVG LPNNICLQKTSNQILKPK-LISYTLPVVGQ SGTCITDPLLAMDEGYFAYSHLERIGSCSR GVSKQRIIGVGEVLDRGDEVPSLFMTNVWT PPNPNTVYHCSAVYNNEFYYVLCAVSTVGD PILNSTYWSGSLMMTRLAVKPK-SNGGGYN QHQLALRSIEKGRYDKVMPYGPSGIKQGDT LYFPAVGFLVRTEFKYNDSNCPITKCQYSK PENCRLSMGIRPNSHYILRSGLLKYNLSDG ENPKWFIEISDQRLSIG-SPSKIYDSLGQP VFYQASFSWDTMIKFGDVLTVNPLVVNWRN NTVISRPGQSQCPRFNTCPAICAEGVYNDA FLIDRINWISAGVFLDSNATAANPVFTVFK DNEILYRAQLASEDTNAQKTITNCFLLK-N KIWCISLVEIYDTGDNVIRPKLFAVKIPEQ CTGGGGSGGGGSGGGGSQVQLVQSGAEVKK PGASVKVSCKASGYTFTNHYMHWVRQAPGQ GLEWMGWMNPNSGNTGYA-QKFQGRVTMTR DTSTSTVYMELSSLRSEDTAVYYCASSESG SDLDYWGQGTLVTVSSGGGGSGGGGSGGGG SDIQMTQSPSSLSASVGDRVTITCRASQTI GNYVNWYQQKPGKAPKLLI-YGASNLHTGV PSRFSGSGSGTDFTLTISSLQPEDFATYYC QQTYSAPLTFGGGTKVEIKR | 1073 |
| NIvG.002_97_2 | KKINEGLLDSKILSAFNTVIALLGSIVIIV MNIMIIQNYTRSTDNQAVIKDAL-QGIQQQ IKGLADKIGTEIGPKVSLIDTSSTITIPAN IGLLGSKISQSTASINENVNEKCKFTLPPL KIHECNISCPNPLPFREYRPQTEGVSNLVG LPNNICLQKTSNQILKPK-LISYTLPWGQS GTCITDPLLAMDEGYFAYSHLERIGSCSRG VSKQRIIGVGEVLDRGDEVPSLFMTNVWTP PNPNTVYHCSAVYNNEFYYVLCAVSTVGDP ILNSTYWSGSLMMTRLAVKPK-SNGGGYNQ HQLALRSIEKGRYDKVMPYGPSGIKQGDTL YFPAVGFLVRTEFKYNDSNCPITKCQYSKP ENCRLSMGIRPNSHYILRSGLLKYNLSDGE NPKWFIEISDQRLSIG-SPSKIYDSLGQPV FYQASFSWDTMIKFGDVLTVNPLVVNWRNN TVISRPGQSQCPRFNTCPAICAEGVYNDAF LIDRINWISAGVFLDSNATAANPVFTVFKD NEILYRAQLASEDTNAQKTITNCFLLK-NK IWCISLVEIYDTGDNVIRPKLFAVKIPEQC TGGGGSGGGGSGGGGSQVQLVESGGGLVQA GGSLRLSCAASGRTFSGYVMGWFRQAPGKQ RKFVAAISRGGLSTSYADSVKGRFTISRDN AK-NTVFLQMNTLKPEDTAVYYCAADRSDL YEITAASNIDSWGQGTLVTVSS | 1074 |

SEQUENCE LISTING (1231 sequences)

SEQ ID NO: 1 - protein, 5 aa, Homo sapiens
SYAIS

SEQ ID NO: 2 - protein, 5 aa, Homo sapiens
TYAIN

SEQ ID NO: 3 - protein, 5 aa, Homo sapiens
SYAIN

SEQ ID NO: 4 - protein, 5 aa, Homo sapiens
GYYMH

SEQ ID NO: 5 - protein, 5 aa, Homo sapiens
DYYIQ

SEQ ID NO: 6 - protein, 5 aa, Homo sapiens
RYDIH

SEQ ID NO: 7 - protein, 5 aa, Homo sapiens
SYAMN

SEQ ID NO: 8 - protein, 5 aa, Homo sapiens
SYYIH

SEQ ID NO: 9 - protein, 5 aa, Homo sapiens
RHYIH

SEQ ID NO: 10 - protein, 5 aa, Homo sapiens
SYGIS

SEQ ID NO: 11 - protein, 5 aa, Homo sapiens
NTDIN

SEQ ID NO: 12 - protein, 5 aa, Homo sapiens
RSYVH

SEQ ID NO: 13 - protein, 5 aa, Homo sapiens
GYYMH

SEQ ID NO: 14 - protein, 5 aa, Homo sapiens
RYYMH

SEQ ID NO: 15 - protein, 5 aa, Homo sapiens
NYDIN

SEQ ID NO: 16 - protein, 5 aa, Homo sapiens
NYYLH

SEQ ID NO: 17 - protein, 5 aa, Homo sapiens
RYSIH

SEQ ID NO: 18 - protein, 5 aa, Homo sapiens
SRDIS

SEQ ID NO: 19 - protein, 5 aa, Homo sapiens
SYDIN

SEQ ID NO: 20 - protein, 5 aa, Homo sapiens
NSDMN

SEQ ID NO: 21 - protein, 5 aa, Homo sapiens
TYDIN

SEQ ID NO: 22 - protein, 5 aa, Homo sapiens
SYTMD

SEQ ID NO: 23 - protein, 5 aa, Homo sapiens
RYDIN

SEQ ID NO: 24 - protein, 5 aa, Homo sapiens
SYYMH

SEQ ID NO: 25 - protein, 5 aa, Homo sapiens
RYAVS

SEQ ID NO: 26 - protein, 5 aa, Homo sapiens
NYAIS

SEQ ID NO: 27 - protein, 36 aa, Artificial Sequence
  Description of Artificial Sequence: Synthetic polypeptide
  SITE (1)..(36): This sequence may encompass 1-6 "Gly Gly Gly Gly Gly Ser" repeating units
GGGGGSGGGGGSGGGGGSGGGGGSGGGGGSGGGGGS

SEQ ID NO: 28 - protein, 5 aa, Homo sapiens
RFDIN

SEQ ID NO: 29 - protein, 5 aa, Homo sapiens
SHAIS

SEQ ID NO: 30 - protein, 5 aa, Homo sapiens
SYGIN

SEQ ID NO: 31 - protein, 5 aa, Homo sapiens
DYDIY

SEQ ID NO: 32 - protein, 5 aa, Homo sapiens
SYHMH

SEQ ID NO: 33 - protein, 5 aa, Homo sapiens
SYPMN

SEQ ID NO: 34 - protein, 5 aa, Homo sapiens
DYYIH

SEQ ID NO: 35 - protein, 5 aa, Homo sapiens
SFEMN

SEQ ID NO: 36 - protein, 5 aa, Homo sapiens
DYAMH

SEQ ID NO: 37 - protein, 5 aa, Homo sapiens
DSYMH

SEQ ID NO: 38 - protein, 5 aa, Homo sapiens
NYYMH

SEQ ID NO: 39 - protein, 5 aa, Homo sapiens
NYYIH

SEQ ID NO: 40 - protein, 5 aa, Homo sapiens
SYYMH

SEQ ID NO: 41 - protein, 5 aa, Homo sapiens
DYYIH

SEQ ID NO: 42 - protein, 5 aa, Homo sapiens
GYYLH

SEQ ID NO: 43 - protein, 5 aa, Homo sapiens
NHYMH

SEQ ID NO: 44 - protein, 5 aa, Homo sapiens
NYYIH

SEQ ID NO: 45 - protein, 5 aa, Homo sapiens
DYYMH

SEQ ID NO: 46 - protein, 5 aa, Homo sapiens
ENEMH

SEQ ID NO: 47 - protein, 5 aa, Homo sapiens
SYDMH

SEQ ID NO: 48 - protein, 5 aa, Homo sapiens
NSDMH

SEQ ID NO: 49 - protein, 5 aa, Homo sapiens
AYYMH

SEQ ID NO: 50 - protein, 5 aa, Homo sapiens
DYHMH

SEQ ID NO: 51 - protein, 5 aa, Homo sapiens
DYYMH

SEQ ID NO: 52 - protein, 5 aa, Homo sapiens
DYYMH

SEQ ID NO: 53 - protein, 5 aa, Homo sapiens
THDIN

SEQ ID NO: 54 - protein, 5 aa, Homo sapiens
NYYIH

SEQ ID NO: 55 - protein, 5 aa, Homo sapiens
DNYMH

SEQ ID NO: 56 - protein, 5 aa, Homo sapiens
SYAIS

SEQ ID NO: 57 - protein, 5 aa, Homo sapiens
TYDIS

SEQ ID NO: 58 - protein, 5 aa, Homo sapiens
SYDIN

SEQ ID NO: 59 - protein, 5 aa, Homo sapiens
SHWIH

SEQ ID NO: 60 - protein, 5 aa, Homo sapiens
DYDIV

SEQ ID NO: 61 - protein, 5 aa, Homo sapiens
GHDMH

SEQ ID NO: 62 - protein, 5 aa, Homo sapiens
NYDMH

SEQ ID NO: 63 - protein, 5 aa, Homo sapiens
SYAMT

SEQ ID NO: 64 - protein, 5 aa, Homo sapiens
TYYMH

SEQ ID NO: 65 - protein, 5 aa, Homo sapiens
NYQIH

SEQ ID NO: 66 - protein, 5 aa, Homo sapiens
SYDIV

SEQ ID NO: 67 - protein, 5 aa, Homo sapiens
SYDIN

SEQ ID NO: 68 - protein, 5 aa, Homo sapiens
SHAIH

SEQ ID NO: 69 - protein, 5 aa, Homo sapiens
SYGIN

SEQ ID NO: 70 - protein, 17 aa, Homo sapiens
IIDPSDGNTNYAQNFQG

SEQ ID NO: 71 - protein, 17 aa, Homo sapiens
RIDPSSGGTKYAQNFQG

SEQ ID NO: 72 - protein, 17 aa, Homo sapiens
IIDPSGGNTNYAQNFQG

SEQ ID NO: 73 - protein, 17 aa, Homo sapiens
HINPNNGDTNYAQNFQG

SEQ ID NO: 74 - protein, 17 aa, Homo sapiens
WINPNSGGTSYAQKFQG

SEQ ID NO: 75 - protein, 17 aa, Homo sapiens
VINPNDGSTRYAQNFQG

SEQ ID NO: 76 - protein, 17 aa, Homo sapiens
RINPNSGGTNYAQKFQG

SEQ ID NO: 77 - protein, 17 aa, Homo sapiens
WMNPNSGNTGYAQKFQG

SEQ ID NO: 78 - protein, 17 aa, Homo sapiens
WISAHNGVTQYAQKFQG

SEQ ID NO: 79 - protein, 17 aa, Homo sapiens
IINPSGGSTSYAQKFQG

SEQ ID NO: 80 - protein, 17 aa, Homo sapiens
WISPYNGNTKYAQKFQG

SEQ ID NO: 81 - protein, 17 aa, Homo sapiens
IINPNSGDTKYAHQFQG

SEQ ID NO: 82 - protein, 17 aa, Homo sapiens
IINPSDGDTKYAQEFQG

SEQ ID NO: 83 - protein, 17 aa, Homo sapiens
WINPNSGDTKYAQKFQG

SEQ ID NO: 84 - protein, 17 aa, Homo sapiens
VIDPSGGSTSYAQKFQG

SEQ ID NO: 85 - protein, 17 aa, Homo sapiens
WIDPKSGDTTYAQKFQG

SEQ ID NO: 86 - protein, 17 aa, Homo sapiens
MINPGAGSSTYAQKFQG

SEQ ID NO: 87 - protein, 17 aa, Homo sapiens
LISGDGGTTYYADSVKG

SEQ ID NO: 88 - protein, 17 aa, Homo sapiens
SINPNSGDTGYAQKFQG

SEQ ID NO: 89 - protein, 17 aa, Homo sapiens
RIIPIFGTANYAQKFQG

SEQ ID NO: 90 - protein, 16 aa, Homo sapiens
AIGTGGGIYYADSVKG

SEQ ID NO: 91 - protein, 17 aa, Homo sapiens
RINPNSGDTNYAQKFQG

SEQ ID NO: 92 - protein, 17 aa, Homo sapiens
MINPSDGSTRYAQKFQG

SEQ ID NO: 93 - protein, 17 aa, Homo sapiens
IINPSDGSTTYAQKFQG

SEQ ID NO: 94 - protein, 17 aa, Homo sapiens
IINPNGGSPSYAQKFQG

SEQ ID NO: 95 - protein, 17 aa, Homo sapiens
IINPSDGSTDYAQNFQG

SEQ ID NO: 96 - protein, 17 aa, Homo sapiens
RINPNTGGTNHAQKFQG

SEQ ID NO: 97 - protein, 17 aa, Homo sapiens
AISGSGGSTYYADSVKG

SEQ ID NO: 98 - protein, 17 aa, Homo sapiens
WISGYNGDTDYARKLQG

SEQ ID NO: 99 - protein, 17 aa, Homo sapiens
WISADNGNTNYEQKVQG

SEQ ID NO: 100 - protein, 17 aa, Homo sapiens
WISPNSGATHYAQKFQG

SEQ ID NO: 101 - protein, 17 aa, Homo sapiens
WINPNSGNTGYAKKFQG

SEQ ID NO: 102 - protein, 17 aa, Homo sapiens
IINPSGGSTRYAQKFQG

SEQ ID NO: 103 - protein, 17 aa, Homo sapiens
WINPKSGATNYAQKFQG

SEQ ID NO: 104 - protein, 17 aa, Homo sapiens
RISESGDSSFYADSVKG

SEQ ID NO: 105 - protein, 16 aa, Homo sapiens
AIGTGGGTYYADSVKG

SEQ ID NO: 106 - protein, 17 aa, Homo sapiens
WMNPSNGDTGYARKFQG

SEQ ID NO: 107 - protein, 17 aa, Homo sapiens
TISPSDGSTTYAQRFQG

SEQ ID NO: 108 - protein, 17 aa, Homo sapiens
IINPSGGSTTYAQKFQG

SEQ ID NO: 109 - protein, 17 aa, Homo sapiens
GFDPEDGETIYAQKFQG

SEQ ID NO: 110 - protein, 17 aa, Homo sapiens
RINPKSGRTYYAQNFQG

SEQ ID NO: 111 - protein, 17 aa, Homo sapiens
VINPGGGSTTYAQTFQG

SEQ ID NO: 112 - protein, 17 aa, Homo sapiens
LMNPKTGDTNYAEKFQG

SEQ ID NO: 113 - protein, 17 aa, Homo sapiens
IIDPSDGYTSYAQKFQG

SEQ ID NO: 114 - protein, 17 aa, Homo sapiens
WINPNSGGTNYAQKFQG

SEQ ID NO: 115 - protein, 17 aa, Homo sapiens
GIMPISGTTIYAQKFQG

SEQ ID NO: 116 - protein, 17 aa, Homo sapiens
WMSPTSGDTGYAQKFQG

SEQ ID NO: 117 - protein, 17 aa, Homo sapiens
WINPNSGDTSYAQKFQG

SEQ ID NO: 118 - protein, 17 aa, Homo sapiens
IIDPSGDITSYAQKFQG

SEQ ID NO: 119 - protein, 17 aa, Homo sapiens
IIETSGGSTDYAQKFQG

SEQ ID NO: 120 - protein, 17 aa, Homo sapiens
IINPNSGGTNYAQKLQG

SEQ ID NO: 121 - protein, 17 aa, Homo sapiens
VISGSGVTTYYADSVKG

SEQ ID NO: 122 - protein, 17 aa, Homo sapiens
WINPNSGGTDYAQKFQG

SEQ ID NO: 123 - protein, 17 aa, Homo sapiens
MINPSGGSTTYAQKFQG

SEQ ID NO: 124 - protein, 17 aa, Homo sapiens
WINPDSGGTNYEQKFQG

SEQ ID NO: 125 - protein, 17 aa, Homo sapiens
WINPNSGGTNSAQKFQG

SEQ ID NO: 126 - protein, 17 aa, Homo sapiens
IINPSGGSASYAQKFQG

SEQ ID NO: 127 - protein, 17 aa, Homo sapiens
IISPSDGSTSYAQKLQG

SEQ ID NO: 128 - protein, 17 aa, Homo sapiens
WINPISGGTHYAQKFQG

SEQ ID NO: 129 - protein, 17 aa, Homo sapiens
WISADNGDTSFAQKFQG

SEQ ID NO: 130 - protein, 17 aa, Homo sapiens
GISPIYGTPAYAQKFQG

SEQ ID NO: 131 - protein, 17 aa, Homo sapiens
IINPSDGDTSYAQKFQG

SEQ ID NO: 132 - protein, 17 aa, Homo sapiens
TINPSGGTTTYAQKFQG

SEQ ID NO: 133 - protein, 17 aa, Homo sapiens
WMNPKSGNTGYAQKFQG

SEQ ID NO: 134 - protein, 17 aa, Homo sapiens
IINPGGGNARHTQKFQG

SEQ ID NO: 135 - protein, 17 aa, Homo sapiens
GFDPEDGETVYAQNFQG

SEQ ID NO: 136 - protein, 17 aa, Homo sapiens
GITPVFGIANYAQKFQG

SEQ ID NO: 137 - protein, 17 aa, Homo sapiens
IINPRGGSTNYAQKFQG

SEQ ID NO: 138 - protein, 17 aa, Homo sapiens
WMNPNNGDTDYAQKFQG

SEQ ID NO: 139 - protein, 17 aa, Homo sapiens
IINPSGGGTSYAQKFQG

SEQ ID NO: 140 - protein, 17 aa, Homo sapiens
LINPGSGNTNYAQKFQG

SEQ ID NO: 141 - protein, 17 aa, Homo sapiens
GIIPIFGTPNYAQKFQG

SEQ ID NO: 142 - protein, 17 aa, Homo sapiens
TINGDGDDTDYADSVKG

SEQ ID NO: 143 - protein, 17 aa, Homo sapiens
QIDPNSGDTIYPQKFQG

SEQ ID NO: 144 - protein, 17 aa, Homo sapiens
IVNPSDGNTNYAQKFQG

SEQ ID NO: 145 - protein, 17 aa, Homo sapiens
WINTYNGNTYYAQKLQG

SEQ ID NO: 146 - protein, 17 aa, Homo sapiens
IINPSDGITDYAQRFQG

SEQ ID NO: 147 - protein, 17 aa, Homo sapiens
IINPRDGDTVYAQKFQG

SEQ ID NO: 148 - protein, 13 aa, Homo sapiens
ERAAAGYYYYMDV

SEQ ID NO: 149 - protein, 13 aa, Homo sapiens
EHAAGTYYYYMDV

SEQ ID NO: 150 - protein, 10 aa, Homo sapiens
EGDYYYGMDA

SEQ ID NO: 151 - protein, 8 aa, Homo sapiens
ERGGMPDY

SEQ ID NO: 152 - protein, 7 aa, Homo sapiens
GHGIPKY

SEQ ID NO: 153 - protein, 8 aa, Homo sapiens
VRSGSPQH

SEQ ID NO: 154 - protein, 11 aa, Homo sapiens
GGPWIVDAFDI

SEQ ID NO: 155 - protein, 13 aa, Homo sapiens
EATWGPYYYYMDV

SEQ ID NO: 156 - protein, 7 aa, Homo sapiens
NKDGLQH

SEQ ID NO: 157 - protein, 13 aa, Homo sapiens
DAKRVGYYYYMDV

SEQ ID NO: 158 - protein, 8 aa, Homo sapiens
LVGGSPDY

SEQ ID NO: 159 - protein, 6 aa, Homo sapiens
GAMVDY

SEQ ID NO: 160 - protein, 13 aa, Homo sapiens
GNYVGSYYYGMDV

SEQ ID NO: 161 - protein, 10 aa, Homo sapiens
DSRGDWYFDL

SEQ ID NO: 162 - protein, 9 aa, Homo sapiens
HGGRGLADY

SEQ ID NO: 163 - protein, 13 aa, Homo sapiens
LKELSSILDAFDI

SEQ ID NO: 164 - protein, 13 aa, Homo sapiens
ERFGTGYYYYMDV

SEQ ID NO: 165 - protein, 12 aa, Homo sapiens
VIGEMVDDAFDL

SEQ ID NO: 166 - protein, 13 aa, Homo sapiens
ERLFGTYYYYMDV

SEQ ID NO: 167 - protein, 8 aa, Homo sapiens
ADGELTDY

SEQ ID NO: 168 - protein, 13 aa, Homo sapiens
HHLPAHYYYYMDV

SEQ ID NO: 169 - protein, 13 aa, Homo sapiens
DVPAGRYYYYMDV

SEQ ID NO: 170 - protein, 13 aa, Homo sapiens
DRGVGRYYYYMDV

SEQ ID NO: 171 - protein, 13 aa, Homo sapiens
DSRYGRYYYYMDV

SEQ ID NO: 172 - protein, 13 aa, Homo sapiens
EIVVGPYYYYMDV

SEQ ID NO: 173 - protein, 13 aa, Homo sapiens
GMVRGPYYYYMDV

SEQ ID NO: 174 - protein, 13 aa, Homo sapiens
EGVTGPYYYYMDV

SEQ ID NO: 175 - protein, 16 aa, Homo sapiens
DAAAGTRYYYYYGMDV

SEQ ID NO: 176 - protein, 13 aa, Homo sapiens
ELYSSTYYYYMDV

SEQ ID NO: 177 - protein, 13 aa, Homo sapiens
ALYSGPYYYYMDV

SEQ ID NO: 178 - protein, 13 aa, Homo sapiens
DSLVGRYYYYMDV

SEQ ID NO: 179 - protein, 6 aa, Homo sapiens
RSELDY

SEQ ID NO: 180 - protein, 6 aa, Homo sapiens
GDDNDY

SEQ ID NO: 181 - protein, 6 aa, Homo sapiens
GEEVDY

SEQ ID NO: 182 - protein, 7 aa, Homo sapiens
GRRVPDY

SEQ ID NO: 183 - protein, 7 aa, Homo sapiens
GKVTTDY

SEQ ID NO: 184 - protein, 7 aa, Homo sapiens
GRELIEY

SEQ ID NO: 185 - protein, 7 aa, Homo sapiens
VYDFPDV

SEQ ID NO: 186 - protein, 8 aa, Homo sapiens
STYSHIDY

SEQ ID NO: 187 - protein, 8 aa, Homo sapiens
EDSSGFDY

SEQ ID NO: 188 - protein, 8 aa, Homo sapiens
DQGGGFDY

SEQ ID NO: 189 - protein, 8 aa, Homo sapiens
DQGWGMDV

SEQ ID NO: 190 - protein, 8 aa, Homo sapiens
LTEGIPDY

SEQ ID NO: 191 - protein, 8 aa, Homo sapiens
DRYGPFDY

SEQ ID NO: 192 - protein, 9 aa, Homo sapiens
LVAGGAPDY

SEQ ID NO: 193 - protein, 9 aa, Homo sapiens
DGFTGDIAY

SEQ ID NO: 194 - protein, 9 aa, Homo sapiens
VDDSSSPDY

SEQ ID NO: 195 - protein, 9 aa, Homo sapiens
GPDGTEVDY

SEQ ID NO: 196 - protein, 9 aa, Homo sapiens
SESGSDLDY

SEQ ID NO: 197 - protein, 10 aa, Homo sapiens
EVEIEGYMDV

SEQ ID NO: 198 - protein, 10 aa, Homo sapiens
DLDDDWYMDV

SEQ ID NO: 199 - protein, 10 aa, Homo sapiens
DSTTWDAFDI

SEQ ID NO: 200 - protein, 10 aa, Homo sapiens
VLVGSGSPDY

SEQ ID NO: 201 - protein, 10 aa, Homo sapiens
EAAAGLDFQH

SEQ ID NO: 202 - protein, 8 aa, Homo sapiens
ANSWDADY

SEQ ID NO: 203 - protein, 11 aa, Homo sapiens
EHSSSWYTFDY

SEQ ID NO: 204 - protein, 11 aa, Homo sapiens
DDDSSGYYLDY

SEQ ID NO: 205 - protein, 14 aa, Homo sapiens
ASGDYMDLIDYMDY

SEQ ID NO: 206 - protein, 11 aa, Homo sapiens
VGSSGYLAPTH

SEQ ID NO: 207 - protein, 11 aa, Homo sapiens
VRGDGYNLGDY

SEQ ID NO: 208 - protein, 11 aa, Homo sapiens
DVDTAMGAGDY

SEQ ID NO: 209 - protein, 12 aa, Homo sapiens
VARWGYGDYPDY

SEQ ID NO: 210 - protein, 12 aa, Homo sapiens
DRNGDYYYGMDV

SEQ ID NO: 211 - protein, 12 aa, Homo sapiens
EGLGSSWYVLDY

SEQ ID NO: 212 - protein, 12 aa, Homo sapiens
DGSHYGYYGMDV

SEQ ID NO: 213 - protein, 12 aa, Homo sapiens
PGPEGYYYGMDV

SEQ ID NO: 214 - protein, 12 aa, Homo sapiens
YHWDYGDYRFDY

SEQ ID NO: 215 - protein, 12 aa, Homo sapiens
VEIDYGDSPPDY

SEQ ID NO: 216 - protein, 12 aa, Homo sapiens
GAEWELRYAFDI

SEQ ID NO: 217 - protein, 13 aa, Homo sapiens
ETYYGLYYYGMDV

SEQ ID NO: 218 - protein, 13 aa, Homo sapiens
APSLRGYSYGPDY

SEQ ID NO: 219 - protein, 13 aa, Homo sapiens
DRQERYYYYYMDV

SEQ ID NO: 220 - protein, 13 aa, Homo sapiens
DRSYGDYYYGMDV

SEQ ID NO: 221 - protein, 13 aa, Homo sapiens
EVFSENYYYYMDV

SEQ ID NO: 222 - protein, 13 aa, Homo sapiens
EWDYTHYYYGMDV

SEQ ID NO: 223 - protein, 13 aa, Homo sapiens
GDSSGYYQYYFDY

SEQ ID NO: 224 - protein, 13 aa, Homo sapiens
GSWDSSSWYIPEY

SEQ ID NO: 225 - protein, 13 aa, Homo sapiens
LVWGGAYYYYMDV

SEQ ID NO: 226 - protein, 13 aa, Homo sapiens
PVFSGSYYWYFDP

SEQ ID NO: 227 - protein, 14 aa, Homo sapiens
DQAVAGPYYYGMDV

SEQ ID NO: 228 - protein, 14 aa, Homo sapiens
DRWLAGPYYYGMDV

SEQ ID NO: 229 - protein, 14 aa, Homo sapiens
VMGPVDYYYYGMDV

SEQ ID NO: 230 - protein, 14 aa, Homo sapiens
DLGPFGSYYYYMDV

SEQ ID NO: 231 - protein, 14 aa, Homo sapiens
EGVVVPPYYYYMDV

SEQ ID NO: 232 - protein, 14 aa, Homo sapiens
SSGWSRYYYYYMDV

SEQ ID NO: 233 - protein, 14 aa, Homo sapiens
DNGMTTGYYYYMDV

SEQ ID NO: 234 - protein, 14 aa, Homo sapiens
DRAMVTGYYYGMDV

SEQ ID NO: 235 - protein, 15 aa, Homo sapiens
DRGYGDRGYYYGMDV

SEQ ID NO: 236 - protein, 15 aa, Homo sapiens
SPKATADYYYYYMDV

SEQ ID NO: 237 - protein, 15 aa, Homo sapiens
STVTPSYYYYYGMDV

SEQ ID NO: 238 - protein, 16 aa, Homo sapiens
EPVAGTGYYYYYGMDV

SEQ ID NO: 239 - protein, 17 aa, Homo sapiens
DNLAGFWSDYYYYGMDV

SEQ ID NO: 240 - protein, 11 aa, Homo sapiens
RASQSISSYLN

SEQ ID NO: 241 - protein, 11 aa, Homo sapiens
QASQDISNYLN

SEQ ID NO: 242 - protein, 16 aa, Homo sapiens
RSSQSLLHSNGYNYLD

SEQ ID NO: 243 - protein, 11 aa, Homo sapiens
RASQSISRNLN

SEQ ID NO: 244 - protein, 12 aa, Homo sapiens
RASQSVSASDLA

SEQ ID NO: 245 - protein, 11 aa, Homo sapiens
QASQDIGNYLN

SEQ ID NO: 246 - protein, 11 aa, Homo sapiens
RASQSISTHLA

SEQ ID NO: 247 - protein, 11 aa, Homo sapiens
RASQTISNYLN

SEQ ID NO: 248 - protein, 11 aa, Homo sapiens
RASQGIRNDLG

SEQ ID NO: 249 - protein, 11 aa, Homo sapiens
RASQSISNYLN

SEQ ID NO: 250 - protein, 11 aa, Homo sapiens
RASQGISDSLA

SEQ ID NO: 251 - protein, 11 aa, Homo sapiens
QASQDIHNYLN

SEQ ID NO: 252 - protein, 11 aa, Homo sapiens
RASQSISDWLA

SEQ ID NO: 253 - protein, 11 aa, Homo sapiens
RASQSISTWLA

SEQ ID NO: 254 - protein, 11 aa, Homo sapiens
RASQSINRFLN

SEQ ID NO: 255 - protein, 11 aa, Homo sapiens
RASQSVSTYLN

SEQ ID NO: 256 - protein, 11 aa, Homo sapiens
QASQDIAKYLN

SEQ ID NO: 257 - protein, 11 aa, Homo sapiens
QASQGITNYLN

SEQ ID NO: 258 - protein, 11 aa, Homo sapiens
QANQDISNFLE

SEQ ID NO: 259 - protein, 11 aa, Homo sapiens
RASQGISNNLN

SEQ ID NO: 260 - protein, 11 aa, Homo sapiens
RASQSISRSLV

SEQ ID NO: 261 - protein, 11 aa, Homo sapiens
QASHDISKSLN

SEQ ID NO: 262 - protein, 11 aa, Homo sapiens
RASQDIGAYLA

SEQ ID NO: 263 - protein, 11 aa, Homo sapiens
RASQSISSYLA

SEQ ID NO: 264 - protein, 11 aa, Homo sapiens
RASQGIRSYLA

SEQ ID NO: 265 - protein, 11 aa, Homo sapiens
RASQNIGTWLA

SEQ ID NO: 266 - protein, 11 aa, Homo sapiens
RASQTISYYLN

SEQ ID NO: 267 - protein, 11 aa, Homo sapiens
RASQNINNYLN

SEQ ID NO: 268 - protein, 11 aa, Homo sapiens
RASQTISTYLN

SEQ ID NO: 269 - protein, 11 aa, Homo sapiens
RASRGIGNDLA

SEQ ID NO: 270 - protein, 11 aa, Homo sapiens
RASQTIGNYVN

SEQ ID NO: 271 - protein, 11 aa, Homo sapiens
RASQFIGSWLA

SEQ ID NO: 272 - protein, 11 aa, Homo sapiens
RASQSISSWMA

SEQ ID NO: 273 - protein, 17 aa, Homo sapiens
KSSQSVLYSSNNKNYLA

SEQ ID NO: 274 - protein, 11 aa, Homo sapiens
RVSQGISSYLN

SEQ ID NO: 275 - protein, 11 aa, Homo sapiens
RASQGISNYLA

SEQ ID NO: 276 - protein, 11 aa, Homo sapiens
RASQSIRNYLT

SEQ ID NO: 277 - protein, 11 aa, Homo sapiens
RASQNIRLYLN

SEQ ID NO: 278 - protein, 11 aa, Homo sapiens
QASQDIRKFLN

SEQ ID NO: 279 - protein, 11 aa, Homo sapiens
QASQDISNYLS

SEQ ID NO: 280 - protein, 11 aa, Homo sapiens
RASQNVRSWLA

SEQ ID NO: 281 - protein, 11 aa, Homo sapiens
RASQGIGNDLG

SEQ ID NO: 282 - protein, 11 aa, Homo sapiens
RASQSISNWLA

SEQ ID NO: 283 - protein, 11 aa, Homo sapiens
RASESIGSWLA

SEQ ID NO: 284 - protein, 12 aa, Homo sapiens
RASQSVTSNYLA

SEQ ID NO: 285 - protein, 11 aa, Homo sapiens
RASQGISSYLA

SEQ ID NO: 286 - protein, 11 aa, Homo sapiens
RASQDIGNYLN

SEQ ID NO: 287 - protein, 11 aa, Homo sapiens
RASQGISNGLS

SEQ ID NO: 288 - protein, 11 aa, Homo sapiens
RASQNIRNYLN

SEQ ID NO: 289 - protein, 11 aa, Homo sapiens
QASLDINNYLN

SEQ ID NO: 290 - protein, 11 aa, Homo sapiens
RASQNIGNYLN

SEQ ID NO: 291 - protein, 11 aa, Homo sapiens
RASQGIRNDLN

SEQ ID NO: 292 - protein, 11 aa, Homo sapiens
RASQGINTWLA

SEQ ID NO: 293 - protein, 11 aa, Homo sapiens
RASQFIGSWLA

SEQ ID NO: 294 - protein, 7 aa, Homo sapiens
AASSLQS

SEQ ID NO: 295 - protein, 7 aa, Homo sapiens
LGSNRAS

SEQ ID NO: 296 - protein, 7 aa, Homo sapiens
KASNLKG

SEQ ID NO: 297 - protein, 7 aa, Homo sapiens
GASTRAT

SEQ ID NO: 298 - protein, 7 aa, Homo sapiens
AASTLQR

SEQ ID NO: 299 - protein, 7 aa, Homo sapiens
AASTLQS

SEQ ID NO: 300 - protein, 7 aa, Homo sapiens
DASTLQS

SEQ ID NO: 301 - protein, 7 aa, Homo sapiens
GASSLRS

SEQ ID NO: 302 - protein, 7 aa, Homo sapiens
DASNLET

SEQ ID NO: 303 - protein, 7 aa, Homo sapiens
SASSLQS

SEQ ID NO: 304 - protein, 7 aa, Homo sapiens
AASSLQT

SEQ ID NO: 305 - protein, 7 aa, Homo sapiens
SASTLQS

SEQ ID NO: 306 - protein, 7 aa, Homo sapiens
DASHLET

SEQ ID NO: 307 - protein, 7 aa, Homo sapiens
AASTLHS

SEQ ID NO: 308 - protein, 7 aa, Homo sapiens
AASSLQN

SEQ ID NO: 309 - protein, 7 aa, Homo sapiens
GASSLQS

SEQ ID NO: 310 - protein, 7 aa, Homo sapiens
SAFSLQS

SEQ ID NO: 311 - protein, 7 aa, Homo sapiens
SASNLQS

SEQ ID NO: 312 - protein, 7 aa, Homo sapiens
DASSLES

SEQ ID NO: 313 - protein, 7 aa, Homo sapiens
EASTLES

SEQ ID NO: 314 - protein, 7 aa, Homo sapiens
GASTLET

SEQ ID NO: 315 - protein, 7 aa, Homo sapiens
AASTLQT

SEQ ID NO: 316 - protein, 7 aa, Homo sapiens
GASTLQS

SEQ ID NO: 317 - protein, 7 aa, Homo sapiens
GASNLET

SEQ ID NO: 318 - protein, 7 aa, Homo sapiens
MGSNRAS

SEQ ID NO: 319 - protein, 7 aa, Homo sapiens
DASTLET

SEQ ID NO: 320 - protein, 7 aa, Homo sapiens
GASNLHT

SEQ ID NO: 321 - protein, 7 aa, Homo sapiens
WASTRES

SEQ ID NO: 322 - protein, 7 aa, Homo sapiens
KTSSLES

SEQ ID NO: 323 - protein, 7 aa, Homo sapiens
TASNLQS

SEQ ID NO: 324 - protein, 7 aa, Homo sapiens
DASNLQS

SEQ ID NO: 325 - protein, 7 aa, Homo sapiens
LASSLQS

SEQ ID NO: 326 - protein, 7 aa, Homo sapiens
STSSLQS

SEQ ID NO: 327 - protein, 7 aa, Homo sapiens
AASSLQR

SEQ ID NO: 328 - protein, 7 aa, Homo sapiens
KASSLES

SEQ ID NO: 329 - protein, 7 aa, Homo sapiens
AASSLQG

SEQ ID NO: 330 - protein, 7 aa, Homo sapiens
AASNLQS

SEQ ID NO: 331 - protein, 7 aa, Homo sapiens
AASTLRS

SEQ ID NO: 332 - protein, 7 aa, Homo sapiens
AASSLHS

SEQ ID NO: 333 - protein, 9 aa, Homo sapiens
QQSYSTPLT

SEQ ID NO: 334 - protein, 9 aa, Homo sapiens
QQSYSNLVS

SEQ ID NO: 335 - protein, 9 aa, Homo sapiens
MQALQTPFT

SEQ ID NO: 336 - protein, 9 aa, Homo sapiens
MQGLQTPHT

SEQ ID NO: 337 - protein, 8 aa, Homo sapiens
QQTYSAPL

SEQ ID NO: 338 - protein, 9 aa, Homo sapiens
MQTLQTPLT

SEQ ID NO: 339 - protein, 9 aa, Homo sapiens
QQYGDSPGS

SEQ ID NO: 340 - protein, 9 aa, Homo sapiens
QQANSFPPT

SEQ ID NO: 341 - protein, 8 aa, Homo sapiens
QQYGNSRT

SEQ ID NO: 342 - protein, 9 aa, Homo sapiens
QQSYSTPPT

SEQ ID NO: 343 - protein, 9 aa, Homo sapiens
QQSYSSPYT

SEQ ID NO: 344 - protein, 9 aa, Homo sapiens
QQSYSTPYT

SEQ ID NO: 345 - protein, 9 aa, Homo sapiens
MQGAHWPPT

SEQ ID NO: 346 - protein, 9 aa, Homo sapiens
QQSYRTPYT

SEQ ID NO: 347 - protein, 9 aa, Homo sapiens
QESFTTQWT

SEQ ID NO: 348 - protein, 10 aa, Homo sapiens
QQRSNWPLYT

SEQ ID NO: 349 - protein, 9 aa, Homo sapiens
QQAISFPIT

SEQ ID NO: 350 - protein, 9 aa, Homo sapiens
QQSYSSPFT

SEQ ID NO: 351 - protein, 9 aa, Homo sapiens
QQAISFPLT

SEQ ID NO: 352 - protein, 9 aa, Homo sapiens
QQSYTFPIT

SEQ ID NO: 353 - protein, 9 aa, Homo sapiens
QQYYSYPPT

SEQ ID NO: 354 - protein, 9 aa, Homo sapiens
QQSYSAPLT

SEQ ID NO: 355 - protein, 9 aa, Homo sapiens
QQSFSTFYT

SEQ ID NO: 356 - protein, 9 aa, Homo sapiens
QQSYSIPFT

SEQ ID NO: 357 - protein, 9 aa, Homo sapiens
QQSYSTPIT

SEQ ID NO: 358 - protein, 9 aa, Homo sapiens
QQSYTIPST

SEQ ID NO: 359 - protein, 9 aa, Homo sapiens
QQSYSAPPT

SEQ ID NO: 360 - protein, 9 aa, Homo sapiens
QQSYSTPWT

SEQ ID NO: 361 - protein, 9 aa, Homo sapiens
QQSYTTPLT

SEQ ID NO: 362 - protein, 9 aa, Homo sapiens
QQSYSAPIT

SEQ ID NO: 363 - protein, 10 aa, Homo sapiens
QQRSNWPPVT

SEQ ID NO: 364 - protein, 9 aa, Homo sapiens
QQSYSIPIT

SEQ ID NO: 365 - protein, 9 aa, Homo sapiens
MQGLQPPGT

SEQ ID NO: 366 - protein, 9 aa, Homo sapiens
QQSYNHFRT

SEQ ID NO: 367 - protein, 9 aa, Homo sapiens
QRSDSTPLT

SEQ ID NO: 368 - protein, 9 aa, Homo sapiens
QQLNSYPRT

SEQ ID NO: 369 - protein, 9 aa, Homo sapiens
QQSYSIPYT

SEQ ID NO: 370 - protein, 9 aa, Homo sapiens
QQTYSTPYT

SEQ ID NO: 371 - protein, 9 aa, Homo sapiens
QQSYSTPQT

SEQ ID NO: 372 - protein, 8 aa, Homo sapiens
MQGTHWPT

SEQ ID NO: 373 - protein, 9 aa, Homo sapiens
QQTFSLPYT

SEQ ID NO: 374 - protein, 9 aa, Homo sapiens
QQGYNMPLT

SEQ ID NO: 375 - protein, 9 aa, Homo sapiens
QQTYSAPLT

SEQ ID NO: 376 - protein, 9 aa, Homo sapiens
QQSYSFPWT

SEQ ID NO: 377 - protein, 9 aa, Homo sapiens
QQTYSTPYI

SEQ ID NO: 378 - protein, 9 aa, Homo sapiens
QQSYSSPWT

SEQ ID NO: 379 - protein, 9 aa, Homo sapiens
QQYASAPRT

SEQ ID NO: 380 - protein, 9 aa, Homo sapiens
QQSFTIPYT

SEQ ID NO: 381 - protein, 9 aa, Homo sapiens
QQTYRTPPT

SEQ ID NO: 382 - protein, 9 aa, Homo sapiens
QQSLTTPFT

SEQ ID NO: 383 - protein, 9 aa, Homo sapiens
QQLNGYPGT

SEQ ID NO: 384 - protein, 9 aa, Homo sapiens
QQSYSLPLT

SEQ ID NO: 385 - protein, 9 aa, Homo sapiens
QQTYTTPRT

SEQ ID NO: 386 - protein, 9 aa, Homo sapiens
QQSYNTPYT

SEQ ID NO: 387 - protein, 9 aa, Homo sapiens
QQSYAPPPT

SEQ ID NO: 388 - protein, 9 aa, Homo sapiens
MQGLQTPLT

SEQ ID NO: 389 - protein, 9 aa, Homo sapiens
QQSDSIPVT

SEQ ID NO: 390 - protein, 9 aa, Homo sapiens
QQSYSTPYN

SEQ ID NO: 391 - protein, 8 aa, Homo sapiens
QHYGSSPA

SEQ ID NO: 392 - protein, 9 aa, Homo sapiens
QQAYTYPYT

SEQ ID NO: 393 - protein, 9 aa, Homo sapiens
QQSYTTPNT

SEQ ID NO: 394 - protein, 9 aa, Homo sapiens
QQSYSTPFT

SEQ ID NO: 395 - protein, 9 aa, Homo sapiens
QQSYSMPLT

SEQ ID NO: 396 - protein, 9 aa, Homo sapiens
QQSYTTPWT

SEQ ID NO: 397 - protein, 9 aa, Homo sapiens
QQSYSSPLT

SEQ ID NO: 398 - protein, 9 aa, Homo sapiens
QQSYSDPLT

SEQ ID NO: 399 - protein, 10 aa, Homo sapiens
QQSYSTPPWT

SEQ ID NO: 400 - protein, 9 aa, Homo sapiens
QQSYQTPLT

SEQ ID NO: 401 - protein, 9 aa, Homo sapiens
QQSYTTPPT

SEQ ID NO: 402 - protein, 9 aa, Homo sapiens
QQANSFPIT

SEQ ID NO: 403 - protein, 9 aa, Homo sapiens
QQSYTVPPT

SEQ ID NO: 404 - protein, 9 aa, Homo sapiens
QQDDSFPLT

SEQ ID NO: 405 - protein, 122 aa, Homo sapiens
QVQLVQSGAEVKKPGASVKVSCKASGGTFSSYAISWVRQAPGQGLEWMGIIDPSDGNTNYAQNFQGRVTMTRDTSTSTVYMELSSLRSEDTAVYYCAKERAAAGYYYYMDVWGQGTTVTVSS

SEQ ID NO: 406 - protein, 122 aa, Homo sapiens
QVQLVQSGAEVKKPGASVKVSCKASGGTFNTYAINWVRQAPGQGLEWMGRIDPSSGGTKYAQNFQGRVTMTRDTSTSTVYMELSSLRSEDTAVYYCAKEHAAGTYYYYMDVWGKGTTVTVSS

SEQ ID NO: 407 - protein, 122 aa, Homo sapiens
QVQLVQSGAEVKKPGASVKVSCKASGGTFSSYAINWVRQAPGQGLEWMGIIDPSGGNTNYAQNFQGRVTMTRDTSTSTVYMELSSLRSEDTAVYYCAKERAAAGYYYYMDVWGQGTTVTVSS

SEQ ID NO: 408 - protein, 119 aa, Homo sapiens
QVQLVQSGAEVKKPGASVKVSCKASGYTFTDYYIQWVRQAPGQGLEWMGWINPNSGGTSYAQKFQGRVTMTRDTSTSTVYMELSSLRSEDTAVYYCAKEGDYYYGMDAWGQGTMVTVSS

SEQ ID NO: 409 - protein, 117 aa, Homo sapiens
QVQLVQSGAEVKKPGASVKVSCKASGYTFTRYDIHWVRQAPGQGLEWMGVINPNDGSTRYAQNFQGRVTMTRDTSTSTVYMELSSLRSEDTAVYYCARERGGMPDYWGQGTLVTVSS

SEQ ID NO: 410 - protein, 116 aa, Homo sapiens
QVQLVQSGAEVKKPGASVKVSCKASGYTFTSYAMNWVRQAPGQGLEWMGRINPNSGGTNYAQKFQGRVTMTRDTSTSTVYMELSSLRSEDTAVYYCARGHGIPKYWGQGTLVTVSS

SEQ ID NO: 411 - protein, 117 aa, Homo sapiens
QVQLVQSGAEVKKPGASVKVSCKASGYTFTSYYIHWVRQAPGQGLEWMGWMNPNSGNTGYAQKFQGRVTMTRDTSTSTVYMELSSLRSEDTAVYYCARVRSGSPQHWGQGTLVTVSS

SEQ ID NO: 412 - protein, 120 aa, Homo sapiens
QVQLVQSGAEVKKPGASVKVSCKASGHTFSRHYIHWVRQAPGQGLEWMGWMNPNSGNTGYAQKFQGRVTMTRDTSTSTVYMELSSLRSEDTAVYYCARGGPWIVDAFDIWGQGTMVTVSS

SEQ ID NO: 413 - protein, 122 aa, Homo sapiens
QVQLVQSGAEVKKPGASVKVSCKASGGTFSNTDINWVRQAPGQGLEWMGIINPSGGSTSYAQKFQGRVTMTRDTSTSTVYMELSSLRSEDTAVYYCAREATWGPYYYYMDVWGKGTTVTVSS

SEQ ID NO: 414 - protein, 116 aa, Homo sapiens
QVQLVQSGAEVKKPGASVKVSCKASGYTFTRSYVHWVRQAPGQGLEWMGWISPYNGNTKYAQKFQGRVTMTRDTSTSTVYMELSSLRSEDTAVYYCVRNKDGLQHWGQGTLVTVSS

SEQ ID NO: 415 - protein, 122 aa, Homo sapiens
QVQLVQSGAEVKKPGASVKVSCKASGDTFTGYYMHWVRQAPGQGLEWMGIINPNSGDTKYAHQFQGRVTMTRDTSTSTVYMELSSLRSEDTAVYYCAKDAKRVGYYYYMDVWGKGTTVTVSS

SEQ ID NO: 416 - protein, 117 aa, Homo sapiens
QVQLVQSGAEVKKPGASVKVSCKASGYTFTRYYMHWVRQAPGQGLEWMGRINPNSGGTNYAQKFQGRVTMTRDTSTSTVYMELSSLRSEDTAVYYCARLVGGSPDYWGQGTLVTVSS

SEQ ID NO: 417 - protein, 115 aa, Homo sapiens
QVQLVQSGAEVKKPGASVKVSCKASGYTFTNYDINWVRQAPGQGLEWMGRINPNSGGTNYAENFQGRVTMTRDTSTSTVYMELSSLRSEDTAVYYCARGAMVDYWGQGTLVTVSS

SEQ ID NO: 418 - protein, 122 aa, Homo sapiens
QVQLVQSGAEVKKPGASVKVSCKASGGTFSNTDINWVRQAPGQGLEWMGIINPSDGDTKYAQEFQGRVTMTRDTSTSTVYMELSSLRSEDTAVYYCARGNYVGSYYYGMDVWGQGTTVTVSS

SEQ ID NO: 419 - protein, 119 aa, Homo sapiens
QVQLVQSGAEVKKPGASVKVSCKASGYTFTNYYLHWVRQAPGQGLEWMGWINPNSGDTKYAQKFQGRVTMTRDTSTSTVYMELSSLRSEDTAVYYCARDSRGDWYFDLWGRGTLVTVSS

SEQ ID NO: 420 - protein, 118 aa, Homo sapiens
QVQLVQSGAEVKKPGASVKVSCKASGYGFTRYSIHWVRQAPGQGLEWMGVIDPSGGSTSYAQKFQGRVTMTRDTSTSTVYMELSSLRSEDTAVYYCTRHGGRGLADYWGQGTLVTVSS

SEQ ID NO: 421 - protein, 122 aa, Homo sapiens
QVQLVQSGAEVKKPGASVKVSCKASGYTFTSRDISWVRQAPGQGLEWMGWIDPKSGDTTYAQKFQGRVTMTRDTSTSTVYMELSSLRSEDTAVYYCARLKELSSILDAFDIWGQGTMVTVSS

SEQ ID NO: 422 - protein, 122 aa, Homo sapiens
QVQLVQSGAEVKKPGASVKVSCKASGYTFTSYDINWVRQAPGQGLEWMGMINPGAGSSTYAQKFQGRVTMTRDTSTSTVYMELSSLRSEDTAVYYCARERFGTGYYYYMDVWGQGTMVTVSS

SEQ ID NO: 423 - protein, 121 aa, Homo sapiens
EVQLLESGGGLVQPGGSLRLSCAASGFTFSNSDMNWVRQAPGKGLEWVSLISGDGGTTYYADSVKGRFTISRDNSKNTLYLQMNSLRAEDTAVYYCARVIGEMVDDAFDLWGQGTTVTVSS

SEQ ID NO: 424 - protein, 122 aa, Homo sapiens
QVQLVQSGAEVKKPGASVKVSCKASGYTFTGYYMHWVRQAPGQGLEWMGSINPNSGDTGYAQKFQGRVTMTRDTSTSTVYMELSSLRSEDTAVYYCARERLFGTYYYYMDVWGKGTTVTVSS

SEQ ID NO: 425 - protein, 117 aa, Homo sapiens
QVQLVQSGAEVKKPGSSVKVSCKASGYTFTTYDINWVRQAPGQGLEWMGRIIPIFGTANYAQKFQGRVTITADESTSTAYMELSSLRSEDTAVYYCARADGELTDYWGQGTLVTVSS

SEQ ID NO: 426 - protein, 121 aa, Homo sapiens
EVQLLESGGGLVQPGGSLRLSCAASGFTFSSYTMDWVRQAPGKGLEWVSAIGTGGGIYYADSVKGRFTISRDNSKNTLYLQMNSLRAEDTAVYYCARHHLPAHYYYYMDVWGKGTTVTVSS

SEQ ID NO: 427 - protein, 122 aa, Homo sapiens
QVQLVQSGAEVKKPGASVKVSCKASGGTFSRYDINWVRQAPGQGLEWMGRINPNSGDTNYAQKFQGRVTMTRDTSTSTVYMELSSLRSEDTAVYYCARDVPAGRYYYYMDVWGKGTLVTVSS

SEQ ID NO: 428 - protein, 122 aa, Homo sapiens
QVQLVQSGAEVKKPGASVKVSCKASGNTFTSYYMHWVRQAPGQGLEWMGMINPSDGSTRYAQKFQGRVTMTRDTSTSTVYMELSSLRSEDTAVYYCAKDRGVGRYYYYMDVWGKGTTVTVSS

SEQ ID NO: 429 - protein, 122 aa, Homo sapiens
QVQLVQSGAEVKKPGASVKVSCKASGGTFSRYAVSWVRQAPGQGLEWMGIINPSDGSTTYAQKFQGRVTMTRDTSTSTVYMELSSLRSEDTAVYYCAKDSRYGRYYYYMDVWGKGTTVTVSS

SEQ ID NO: 430 - protein, 122 aa, Homo sapiens
QVQLVQSGAEVKKPGSSVKVSCKASGGTFSNYAISWVRQAPGQGLEWMGIINPNGGSPSYAQKFQGRVTITADESTSTAYMELSSLRSEDTAVYYCAKEIVVGPYYYYMDVWGKGTTVTVSS

SEQ ID NO: 431 - protein, 122 aa, Homo sapiens
QVQLVQSGAEVKKPGSSVKVSCKASGGTFTRYAISWVRQAPGQGLEWMGRINPNSGDTNYAQKFQGRVTITADESTSTAYMELSSLRSEDTAVYYCARGMVRGPYYYYMDVWGKGTTVTVSS

SEQ ID NO: 432 - protein, 122 aa, Homo sapiens
QVQLVQSGAEVKKPGSSVKVSCKASGGTFSSYAISWVRQAPGQGLEWMGIINPSGGSTSYAQTFQGRVTITADESTSTAYMELSSLRSEDTAVYYCAREGVTGPYYYYMDVWGQGTTVTVSS

SEQ ID NO: 433 - protein, 125 aa, Homo sapiens
QVQLVQSGAEVKKPGASVKVSCKASGGTFSRFDINWVRQAPGQGLEWMGIINPSDGSTDYAQNFQGRVTMTRDTSTSTVYMELSSLRSEDTAVYYCARDAAAGTRYYYYYGMDVWGQGTTVTVSS

SEQ ID NO: 434 - protein, 122 aa, Homo sapiens
QVQLVQSGAEVKKPGASVKVSCKASGGTFSSHAISWVRQAPGQGLEWMGIINPSGGSTSYAQKFQGRVTMTRDTSTSTVYMELSSLRSEDTAVYYCARELYSSTYYYYMDVWGKGTTVTVSS

SEQ ID NO: 435 - protein, 122 aa, Homo sapiens
QVQLVQSGAEVKKPGASVKVSCKASGGTFSSYAISWVRQAPGQGLEWMGRINPNTGGTNHAQKFQGRVTMTRDTSTSTVYMELSSLRSEDTAVYYCARALYSGPYYYYMDVWGKGTTVTVSS

SEQ ID NO: 436 - protein, 122 aa, Homo sapiens
EVQLLESGGGLVQPGGSLRLSCAASGFTFSNSDMNWVRQAPGKGLEWVSAISGSGGSTYYADSVKGRFTISRDNSKNTLYLQMNSLRAEDTAVYYCAKEHAAGTYYYYMDVWGKGTTVTVSS

SEQ ID NO: 437 - protein, 122 aa, Homo sapiens
QVQLVQSGAEVKKPGASVKVSCKASGGTFGSYGINWVRQAPGQGLEWMGWISGYNGDTDYARKLQGRVTMTRDTSTSTVYMELSSLRSEDTAVYYCARDSLVGRYYYYMDVWGKGTTVTVSS

SEQ ID NO: 438 - protein, 115 aa, Homo sapiens
QVQLVQSGAEVKKPGASVKVSCKASGYIFTDYDIYWVRQAPGQGLEWLGWISADNGNTNYEQKVQGRVTMTRDTSTSTVYMELSSLRSEDTAVYYCARRSELDYWGQGTLVTVSS

SEQ ID NO: 439 - protein, 115 aa, Homo sapiens
QVQLVQSGAEVKKPGASVKVSCKASGYTFTSYHMHWVRQAPGQGLEWMGWISPNSGATHYAQKFQGRVTMTRDTSTSTVYMELSSLRSEDTAVYYCARGDDNDYWGQGTLVTVSS

SEQ ID NO: 440 - protein, 115 aa, Homo sapiens
QVQLVQSGAEVKKPGASVKVSCKASGYTFTSYDINWVRQAPGQGLEWMGWINPNSGNTGYAKKFQGRVTMTRDTSTSTVYMELSSLRSEDTAVYYCARGEEVDYWGQGTLVTVSS

SEQ ID NO: 441 - protein, 116 aa, Homo sapiens
QVQLVQSGAEVKKPGASVKVSCKASGYTFTSYPMNWVRQAPGQGLEWMGIINPSGGSTRYAQKFQGRVTMTRDTSTSTVYMELSSLRSEDTAVYYCARGRRVPDYWGQGTLVTVSS

SEQ ID NO: 442 - protein, 116 aa, Homo sapiens
QVQLVQSGAEVKKPGASVKVSCKASGYTFTDYYIHWVRQAPGQGLEWMGWINPKSGATNYAQKFQGRVTMTRDTSTSTVYMELSSLRSEDTAVYYCARGKVTTDYWGQGTLVTVSS

SEQ ID NO: 443 - protein, 116 aa, Homo sapiens
EVQLLESGGGLVQPGGSLRLSCAASGFTFSSFEMNWVRQAPGKGLEWVSRISESGDSSFYADSVKGRFTISRDNSKNTLYLQMNSLRAEDTAVYYCASGRELIEYWGQGTLVTVSS

SEQ ID NO: 444 - protein, 115 aa, Homo sapiens
EVQLLESGGGLVQPGGSLRLSCAASGFTFDDYAMHWVRQAPGKGLEWVSAIGTGGGTYYADSVKGRFTISRDNSKNTLYLQMNSLRAEDTAVYYCARVYDFPDVWGQGTTVTVSS

SEQ ID NO: 445 - protein, 117 aa, Homo sapiens
QVQLVQSGAEVKKPGASVKVSCKASGYTFTDSYMHWVRQAPGQGLEWMGWMNPSNGDTGYARKFQGRVTMTRDTSTSTVYMELSSLRSEDTAVYYCARSTYSHIDYWGQGTLVTVSS

SEQ ID NO: 446 - protein, 117 aa, Homo sapiens
QVQLVQSGAEVKKPGASVKVSCKASGYTFTNYYMHWVRQAPGQGLEWMGTISPSDGSTTYAQRFQGRVTMTRDTSTSTVYMELSSLRSEDTAVYYCAREDSSGFDYWGQGTLVTVSS

SEQ ID NO: 447 - protein, 117 aa, Homo sapiens
QVQLVQSGAEVKKPGASVKVSCKASGYTFMNYYIHWVRQAPGQGLEWMGIINPSGGSTTYAQKFQGRVTMTRDTSTSTVYMELSSLRSEDTAVYYCARDQGGGFDYWGQGTLVTVSS

SEQ ID NO: 448 - protein, 117 aa, Homo sapiens
QVQLVQSGAEVKKPGASVKVSCKASGYTFTSYYMHWVRQAPGQGLEWMGGFDPEDGETIYAQKFQGRVTMTRDTSTSTVYMELSSLRSEDTAVYYCARDQGWGMDVWGQGTTVTVSS

SEQ ID NO: 449 - protein, 117 aa, Homo sapiens
QVQLVQSGAEVKKPGASVKVSCKASGYTFTSYYIHWVRQAPGQGLEWMGRINPKSGRTYYAQNFQGRVTMTRDTSTSTVYMELSSLRSEDTAVYYCARLTEGIPDYWGQGTLVTVSS

SEQ ID NO: 450 - protein, 117 aa, Homo sapiens
QVQLVQSGAEVKKPGASVKVSCKASGYTLNDYYIHWVRQAPGQGLEWMGVINPGGGSTTYAQTFQGRVTMTRDTSTSTVYMELSSLRSEDTAVYYCARDRYGPFDYWGQGTLVTVSS

SEQ ID NO: 451 - protein, 118 aa, Homo sapiens
QVQLVQSGAEVKKPGASVKVSCKASGYTFTSYDINWVRQAPGQGLEWMGLMNPKTGDTNYAEKFQGRVTMTRDTSTSTVYMELSSLRSEDTAVYYCTRLVAGGAPDYWGQGTLVTVSS

SEQ ID NO: 452 - protein, 118 aa, Homo sapiens
QVQLVQSGAEVKKPGASVKVSCKASGYTFTGYYMHWVRQAPGQGLEWMGIIDPSDGYTSYAQKFQGRVTMTRDTSTSTVYMELSSLRSEDTAVYYCARDGFTGDIAYWGQGTLVTVSS

SEQ ID NO: 453 - protein, 118 aa, Homo sapiens
QVQLVQSGAEVKKPGSSVKVSCKASGYTFTGYYMHWVRQAPGQGLEWMGWINPNSGGTNYAQKFQGRVTITADESTSTAYMELSSLRSEDTAVYYCARVDDSSSPDYWGQGTLVTVSS

SEQ ID NO: 454 - protein, 118 aa, Homo sapiens
QVQLVQSGAEVKKPGSSVKVSCKASGYTFTGYYLHWVRQAPGQGLEWMGGIMPISGTTIYAQKFQGRVTITADESTSTAYMELSSLRSEDTAVYYCTTGPDGTEVDYWGQGTLVTVSS

SEQ ID NO: 455 - protein, 118 aa, Homo sapiens
QVQLVQSGAEVKKPGASVKVSCKASGYTFTNHYMHWVRQAPGQGLEWMGWMNPNSGNTGYAQKFQGRVTMTRDTSTSTVYMELSSLRSEDTAVYYCASSESGSDLDYWGQGTLVTVSS

SEQ ID NO: 456 - protein, 119 aa, Homo sapiens
QVQLVQSGAEVKKPGASVKVSCKASGYTFTNYYIHWVRQAPGQGLEWMGWMSPTSGDTGYAQKFQGRVTMTRDTSTSTVYMELSSLRSEDTAVYYCAREVEIEGYMDVWGQGTTVTVSS

SEQ ID NO: 457 - protein, 119 aa, Homo sapiens
QVQLVQSGAEVKKPGASVKVSCKASGYTFTSYYMHWVRQAPGQGLEWMGWINPNSGDTSYAQKFQGRVTMTRDTSTSTVYMELSSLRSEDTAVYYCAKDLDDDWYMDVWGKGTTVTVSS

SEQ ID NO: 458 - protein, 119 aa, Homo sapiens
QVQLVQSGAEVKKPGASVKVSCKASGYTFTSYYMHWVRQAPGQGLEWMGIIDPSGDITSYAQKFQGRVTMTRDTSTSTVYMELSSLRSEDTAVYYCTTDSTTWDAFDIWGQGTMVTVSS

SEQ ID NO: 459 - protein, 119 aa, Homo sapiens
QVQLVQSGAEVKKPGASVKVSCKASGYTFTDYYMHWVRQAPGQGLEWMGWINPNSGGTNYAQKFQGRVTMTRDTSTSTVYMELSSLRSEDTAVYYCARVLVGSGSPDYWGQGTLVTVSS

SEQ ID NO: 460 - protein, 119 aa, Homo sapiens
QVQLVQSGAEVKKPGASVKVSCKASGYTFTENEMHWVRQAPGQGLEWMGIIETSGGSTDYAQKFQGRVTMTRDTSTSTVYMELSSLRSEDTAVYYCAREAAAGLDFQHWGQGTLVTVSS

SEQ ID NO: 461 - protein, 120 aa, Homo sapiens
QVQLVQSGAEVKKPGASVKVSCKASGYTFASYDMHWVRQAPGQGLEWMGIINPNSGGTNYAQKLQGRVTMTRDTSTSTVYMELSSLRSEDTAVYYCARANSWDAMVIDYWGQGTLVTVSS

SEQ ID NO: 462 - protein, 120 aa, Homo sapiens
EVQLLESGGGLVQPGGSLRLSCAASGFTFSNSDMHWVRQAPGKGLEWVSVISGSGVTTYYADSVKGRFTISRDNSKNTLYLQMNSLRAEDTAVYYCAREHSSSWYTFDYWGQGTLVTVSS

SEQ ID NO: 463 - protein, 120 aa, Homo sapiens
QVQLVQSGAEVKKPGASVKVSCKASGYTFTAYYMHWVRQAPGQGLEWLGWINPNSGGTDYAQKFQGRVTMTRDTSTSTVYMELSSLRSEDTAVYYCARDDDSSGYYLDYWGQGTLVTVSS

SEQ ID NO: 464 - protein, 120 aa, Homo sapiens
QVQLVQSGAEVKKPGASVKVSCKASGYTFTNYYIHWVRQAPGQGLEWMGMINPSGGSTTYAQKFQGRVTMTRDTSTSTVYMELSSLRSEDTAVYYCARASGDYMDLIDYWGQGTLVTVSS

SEQ ID NO: 465 - protein, 120 aa, Homo sapiens
QVQLVQSGAEVKKPGASVKVSCKASGYTFTDYHMHWVRQAPGQGLEWLGWINPDSGGTNYEQKFQGRVTMTRDTSTSTVYMELSSLRSEDTAVYYCALVGSSGYLAPTHWGQGTLVTVSS

SEQ ID NO: 466 - protein, 120 aa, Homo sapiens
QVQLVQSGAEVKKPGSSVKVSCKASGYPFTDYYMHWVRQAPGQGLEWMGWMNPNSGNTGYAQKFQGRVTITADESTSTAYMELSSLRSEDTAVYYCARVRGDGYNLGDYWGQGTLVTVSS

SEQ ID NO: 467 - protein, 120 aa, Homo sapiens
QVQLVQSGAEVKKPGASVKVSCKASGYTFSDYYMHWVRQAPGQGLEWMGWINPNSGGTNSAQKFQGRVTMTRDTSTSTVYMELSSLRSEDTAVYYCARDVDTAMGAGDYWGQGTLVTVSS

SEQ ID NO: 468 - protein, 121 aa, Homo sapiens
QVQLVQSGAEVKKPGASVKVSCKASGYTFTDYYIHWVRQAPGQGLEWIGIINPSGGSASYAQKFQGRVTMTRDTSTSTVYMELSSLRSEDTAVYYCARVARWGYGDYPDYWGQGTLVTVSS

SEQ ID NO: 469 - protein, 121 aa, Homo sapiens
QVQLVQSGAEVKKPGASVKVSCKASGDTFTTHDINWVRQAPGQGLEWMGIISPSDGSTSYAQKLQGRVTMTRDTSTSTVYMELSSLRSEDTAVYYCARDRNGDYYYGMDVWGQGTTVTVSS

SEQ ID NO: 470 - protein, 121 aa, Homo sapiens
QVQLVQSGAEVKKPGASVKVSCKASGDTFTNYYIHWVRQAPGQGLEWMGWINPISGGTHYAQKFQGRVTMTRDTSTSTVYMELSSLRSEDTAVYYCAREGLGSSWYVLDYWGQGTLVTVSS

SEQ ID NO: 471 - protein, 121 aa, Homo sapiens
QVQLVQSGAEVKKPGASVKVSCKASGYTFTSYDINWVRQAPGQGLEWMGWISADNGDTSFAQKFQGRVTMTRDTSTSTVYMELSSLRSEDTAVYYCARDGSHYGYYGMDVWGQGTTVTVSS

SEQ ID NO: 472 - protein, 121 aa, Homo sapiens
QVQLVQSGAEVKKPGSSVKVSCKASGYTFTSYDINWVRQAPGQGLEWMGGISPIYGTPAYAQKFQGRVTITADESTSTAYMELSSLRSEDTAVYYCASPGPEGYYYGMDVWGQGTTVTVSS

SEQ ID NO: 473 - protein, 121 aa, Homo sapiens
QVQLVQSGAEVKKPGASVKVSCKASGYTFTDNYMHWVRQAPGQGLEWMGWMNPNSGNTGYAQKFQGRVTMTRDTSTSTVYMELSSLRSEDTAVYYCASYHWDYGDYRFDYWGQGTLVTVSS

SEQ ID NO: 474 - protein, 121 aa, Homo sapiens
QVQLVQSGAEVKKPGASVKVSCKASGYTFTSYYIHWVRQAPGQGLEWMGWMNPNSGNTGYAQKFQGRVTMTRDTSTSTVYMELSSLRSEDTAVYYCARVEIDYGDSPPDYWGQGTLVTVSS

SEQ ID NO: 475 - protein, 121 aa, Homo sapiens
QVQLVQSGAEVKKPGASVKVSCKASGGTSSSYAISWVRQAPGQGLEWMGIINPSDGDTSYAQKFQGRVTMTRDTSTSTVYMELSSLRSEDTAVYYCARGAEWELRYAFDIWGQGTMVTVSS

SEQ ID NO: 476 - protein, 122 aa, Homo sapiens
QVQLVQSGAEVKKPGASVKVSCKASGYTFTTYDISWVRQAPGQGLEWMGTINPSGGTTTYAQKFQGRVTMTRDTSTSTVYMELSSLRSEDTAVYYCARETYYGLYYYGMDVWGKGTTVTVSS

SEQ ID NO: 477 - protein, 122 aa, Homo sapiens
QVQLVQSGAEVKKPGASVKVSCKASGYTFTSYDINWVRQAPGQGLEWMGWMNPKSGNTGYAQKFQGRVTMTRDTSTSTVYMELSSLRSEDTAVYYCARAPSLRGYSYGPDYWGQGTLVTVSS

SEQ ID NO: 478 - protein, 122 aa, Homo sapiens
QVQLVQSGAEVKKPGASVKVSCKASGGTFTSYDINWVRQAPGQGLEWMGIINPSGGSTSYAQKFQGRVTMTRDTSTSTVYMELSSLRSEDTAVYYCAKDRQERYYYYYMDVWGKGTLVTVSS

SEQ ID NO: 479 - protein, 122 aa, Homo sapiens
QVQLVQSGAEVKKPGASVKVSCKASGYTFTSYDINWVRQAPGQGLEWMGIINPSDGSTDYAQKFQGRVTMTRDTSTSTVYMELSSLRSEDTAVYYCAKDRSYGDYYYGMDVWGQGTTVTVSS

SEQ ID NO: 480 - protein, 122 aa, Homo sapiens
QVQLVQSGAEVKKPGASVKVSCKASGGTFTSYDINWVRQAPGQGLEWMGIINPGGGNARHTQKFQGRVTMTRDTSTSTVYMELSSLRSEDTAVYYCAREVFSENYYYYMDVWGKGTTVTVSS

SEQ ID NO: 481 - protein, 122 aa, Homo sapiens
QVQLVQSGAEVKKPGASVKVSCKASGYTFTSYYMHWVRQAPGQGLEWMGIINPSDGSTTYAQKFQGRVTMTRDTSTSTVYMELSSLRSEDTAVYYCAREWDYTHYYYGMDVWGQGTTVTVSS

SEQ ID NO: 482 - protein, 122 aa, Homo sapiens
QVQLVQSGAEVKKPGASVKVSCKASGNTFTSHWIHWVRQAPGQGLEWMGGFDPEDGETVYAQNFQGRVTMTRDTSTSTVYMELSSLRSEDTAVYYCARGDSSGYYQYYFDYWGQGTLVTVSS

SEQ ID NO: 483 - protein, 122 aa, Homo sapiens
QVQLVQSGAEVKKPGSSVKVSCKASGYTFTSYDINWVRQAPGQGLEWMGGITPVFGIANYAQKFQGRVTITADESTSTAYMELSSLRSEDTAVYYCARGSWDSSSWYIPEYWGQGTLVTVSS

SEQ ID NO: 484 - protein, 122 aa, Homo sapiens
QVQLVQSGAEVKKPGASVKVSCKASGFTFSDYDIVWVRQAPGQGLEWMGIINPRGGSTNYAQKFQGRVTMTRDTSTSTVYMELSSLRSEDTAVYYCASLVWGGAYYYYMDVWGQGTTVTVSS

SEQ ID NO: 485 - protein, 122 aa, Homo sapiens
QVQLVQSGAEVKKPGASVKVSCKASGYTFTSYGISWVRQAPGQGLEWMGWMNPNNGDTDYAQKFQGRVTMTRDTSTSTVYMELSSLRSEDTAVYYCTTPVFSGSYYWYFDPWGQGTLVTVSS

SEQ ID NO: 486 - protein, 123 aa, Homo sapiens
QVQLVQSGAEVKKPGASVKVSCKASGYTFTSYDINWVRQAPGQGLEWMGIINPSGGGTSYAQKFQGRVTMTRDTSTSTVYMELSSLRSEDTAVYYCTTDQAVAGPYYYGMDVWGQGTLVTVSS

SEQ ID NO: 487 - protein, 123 aa, Homo sapiens
QVQLVQSGAEVKKPGASVKVSCKASGGTFSSYAISWVRQAPGQGLEWMGLINPGSGNTNYAQKFQGRVTMTRDTSTSTVYMELSSLRSEDTAVYYCARDRWLAGPYYYGMDVWGQGTTVTVSS

SEQ ID NO: 488 - protein, 123 aa, Homo sapiens
QVQLVQSGAEVKKPGSSVKVSCKASGYMFTGHDMHWVRQAPGQGLEWMGGIIPIFGTPNYAQKFQGRVTITADESTSTAYMELSSLRSEDTAVYYCARVMGPVDYYYYGMDVWGQGTTVTVSS

SEQ ID NO: 489 - protein, 123 aa, Homo sapiens
QVQLVQSGAEVKKPGASVKVSCKASGYIFSNYDMHWVRQAPGQGLEWMGIINPSDGSTTYAQKFQGRVTMTRDTSTSTVYMELSSLRSEDTAVYYCARDLGPFGSYYYYMDVWGKGTTVTVSS

SEQ ID NO: 490 - protein, 123 aa, Homo sapiens
EVQLVESGGGLVKPGGSLRLSCAASGFTFSSYAMTWVRQAPGKGLEWVSTINGDGDDTDYADSVKGRFTISRDDSKNTLYLQMNSLKTEDTAVYYCAREGVVVPPYYYYMDVWGKGTTVTVSS

SEQ ID NO: 491 - protein, 123 aa, Homo sapiens
QVQLVQSGAEVKKPGASVKVSCKASGYTFTTYYMHWVRQAPGQGLEWMGQIDPNSGDTIYPQKFQGRVTMTRDTSTSTVYMELSSLRSEDTAVYYCARSSGWSRYYYYYMDVWGKGTTVTVSS

SEQ ID NO: 492 - protein, 123 aa, Homo sapiens
QVQLVQSGAEVKKPGASVKVSCKASGSTFTNYQIHWVRQAPGQGLEWMGIINPSGGSTSYAQKFQGRVTMTRDTSTSTVYMELSSLRSEDTAVYYCARDNGMTTGYYYYMDVWGKGTTVTVSS

SEQ ID NO: 493 - protein, 123 aa, Homo sapiens
QVQLVQSGAEVKKPGASVKVSCKASGYTFTSYDIVWVRQAPGQGLEWMGIINPSGGSTSYAQKFQGRVTMTRDTSTSTVYMELSSLRSEDTAVYYCARDRAMVTGYYYGMDVWGQGTTVTVSS

SEQ ID NO: 494 - protein, 124 aa, Homo sapiens
QVQLVQSGAEVKKPGASVKVSCKASGYTFTSYDINWVRQAPGQGLEWMGIVNPSDGNTNYAQKFQGRVTMTRDTSTSTVYMELSSLRSEDTAVYYCARDRGYGDRGYYYGMDVWGQGTTVTVSS

SEQ ID NO: 495 - protein, 124 aa, Homo sapiens
QVQLVQSGAEVKKPGASVKVSCKASGGTLSSYDINWVRQAPGQGLEWMGWINTYNGNTYYAQKLQGRVTMTRDTSTSTVYMELSSLRSEDTAVYYCATSPKATADYYYYYMDVWGKGTTVTVSS

SEQ ID NO: 496 - protein, 124 aa, Homo sapiens
QVQLVQSGAEVKKPGASVKVSCKASGYTFTSYDINWVRQAPGQGLEWMGIINPSDGITDYAQRFQGRVTMTRDTSTSTVYMELSSLRSEDTAVYYCTTSTVTPSYYYYYGMDVWGQGTTVTVSS

SEQ ID NO: 497 - protein, 125 aa, Homo sapiens
QVQLVQSGAEVKKPGASVKVSCKASGYTFTSHAIHWVRQAPGQGLEWMGIINPRDGDTVYAQKFQGRVTMTRDTSTSTVYMELSSLRSEDTAVYYCAREPVAGTGYYYYYGMDVWGQGTLVTVSS

SEQ ID NO: 498 - protein, 126 aa, Homo sapiens
QVQLVQSGAEVKKPGASVKVSCKASGGTFNSYGINWVRQAPGQGLEWMGWMNPNSGNTGYAQKFQGRVTMTRDTSTSTVYMELSSLRSEDTAVYYCARDNLAGFWSDYYYYGMDVWGQGTTVTVSS

SEQ ID NO: 499 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR

SEQ ID NO: 500 - protein, 108 aa, Homo sapiens
DIQMTQSPSSLSASVGDRVTITCQASQDISNYLNWYQQKPGKAPKLLIYAASSLQSGVPSRFSGSGSGTDFTLTISSLQPEDFATYYCQQSYSNLVSFGQGTKVEIKR

SEQ ID NO: 501 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIKR

SEQ ID NO: 502 - protein, 113 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVDIKR

SEQ ID NO: 503 - protein, 113 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPHTFGQGTKVEIKR

SEQ ID NO: 504 - protein, 107 aa, Homo sapiens
DIQMTQSPSSLSASVGDRVTITCRASQSISRNLNWYQQKPGKAPKLLIYKASNLKGGVPSRFSGSGSGTDFTLTISSLQPEDFATYYCQQTYSAPLFGQGTKLEIKR

SEQ ID NO: 505 - protein, 113 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQTLQTPLTFGQGTKVEIKR

SEQ ID NO: 506 - protein, 109 aa, Homo sapiens
EIVMTQSPATLSVSPGERATLSCRASQSVSASDLAWYQQKPGQAPRLLIYGASTRATGIPARFSGSGSGTEFTLTISSLQSEDFAVYYCQQYGDSPGSFGQGTKLEIKR

SEQ ID NO: 507 - protein, 108 aa, Homo sapiens
DIQMTQSPSSLSASVGDRVTITCQASQDIGNYLNWYQQKPGKAPKLLIYAASTLQRGVPSRFSGSGSGTDFTLTISSLQPEDFATYYCQQANSFPPTFGGGTKVEIKR

SEQ ID NO: 508 - protein, 107 aa, Homo sapiens
EIVMTQSPATLSVSPGERATLSCRASQSISTHLAWYQQKPGQAPRLLIYGASTRATGIPARFSGSGSGTEFTLTISSLQSEDFAVYYCQQYGNSRTFGQGTKVEIKR

SEQ ID NO: 509 - protein, 108 aa, Homo sapiens
DIQMTQSPSSLSASVGDRVTITCRASQTISNYLNWYQQKPGKAPKLLIYAASTLQSGVPSRFSGSGSGTDFTLTISSLQPEDFATYYCQQSYSTPPTFGQGTKLEIKR

SEQ ID NO: 510 - protein, 108 aa, Homo sapiens
DIQMTQSPSSLSASVGDRVTITCRASQGIRNDLGWYQQKPGKAPKLLIYDASTLQSGVPSRFSGSGSGTDFTLTISSLQPEDFATYYCQQSYSSPYTFGQGTKLEIKR

SEQ ID NO: 511 - protein, 108 aa, Homo sapiens
DIQMTQSPSSLSASVGDRVTITCRASQSISNYLNWYQQKPGKAPKLLIYAASSLQSGVPSRFSGSGSGTDFTLTISSLQPEDFATYYCQQSYSTPYTFGQGTKLEIKR

SEQ ID NO: 512 - protein, 113 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGAHWPPTFGQGTKLEIKR

SEQ ID NO: 513 - protein, 108 aa, Homo sapiens
DIQMTQSPSSLSASVGDRVTITCRASQGISDSLAWYQQKPGKAPKLLIYGASSLRSGVPSRFSGSGSGTDFTLTISSLQPEDFATYYCQQSYRTPYTFGQGTKLEIKR

SEQ ID NO: 514 - protein, 108 aa, Homo sapiens
DIQMTQSPSSLSASVGDRVTITCRASQSISNYLNWYQQKPGKAPKLLIYAASSLQSGVPSRFSGSGSGTDFTLTISSLQPEDFATYYCQESFTTQWTFGQGTKVEIKR

SEQ ID NO: 515 - protein, 108 aa, Homo sapiens
DIQMTQSPSSLSASVGDRVTITCQASQDIHNYLNWYQQKPGKAPKLLIYDASNLETGVPSRFSGSGSGTDFTLTISSLQPEDFATYYCQQANSFPPTFGPGTKVDIKR

SEQ ID NO: 516 - protein, 109 aa, Homo sapiens
DIQMTQSPSSLSASVGDRVTITCQASQDISNYLNWYQQKPGKAPKLLIYSASSLQSGVPSRFSGSGSGTDFTLTISSLQPEDFATYYCQQRSNWPLYTFGQGTKVEIKR

SEQ ID NO: 517 - protein, 108 aa, Homo sapiens
DIQMTQSPSSLSASVGDRVTITCRASQSISDWLAWYQQKPGKAPKLLIYAASSLQTGVPSRFSGSGSGTDFTLTISSLQPEDFATYYCQQAISFPITFGQGTKVEIKR

SEQ ID NO: 518 - protein, 108 aa, Homo sapiens
DIQMTQSPSSLSASVGDRVTITCQASQDISNYLNWYQQKPGKAPKLLIYSASTLQSGVPSRFSGSGSGTDFTLTISSLQPEDFATYYCQQSYSSPFTFGPGTKVDIKR

SEQ ID NO: 519 - protein, 108 aa, Homo sapiens
DIQMTQSPSSLSASVGDRVTITCRASQSISTWLAWYQQKPGKAPKLLIYAASTLQSGVPSRFSGSGSGTDFTLTISSLQPEDFATYYCQQAISFPLTFGGGTKVEIKR

SEQ ID NO: 520 - protein, 108 aa, Homo sapiens
DIQMTQSPSSLSASVGDRVTITCRASQSISNYLNWYQQKPGKAPKLLIYAASTLQSGVPSRFSGSGSGTDFTLTISSLQPEDFATYYCQQSYTFPITFGQGTRLEIKR

SEQ ID NO: 521 - protein, 113 aa, Homo sapiens
DIVMTQSPLSLPVTPGEPASISCRSSQSLLHSNGYNYLDWYLQKPGQSPQLLIYDASHLETGVPDRFSGSGSGTDFTLKISRVEAEDVGVYYCQQYYSYPPTFGQGTKVEIKR

SEQ ID NO: 522 - protein, 108 aa, Homo sapiens
DIQMTQSPSSLSASVGDRVTITCQASQDISNYLNWYQQKPGKAPKLLIYAASTLHSGVPSRFSGSGSGTDFTLTISSLQPEDFATYYCQQSYSAPLTFGPGTKVDIKR

SEQ ID NO: 523 - protein, 108 aa, Homo sapiens
DIQMTQSPSSLSASVGDRVTITCQASQDISNYLNWYQQKPGKAPKLLIYAASTLQSGVPSRFSGSGSGTDFTLTISSLQPEDFATYYCQQSFSTFYTFGQGTKVEIKR

SEQ ID NO: 524 - protein, 108 aa, Homo sapiens
DIQMTQSPSSLSASVGDRVTITCQASQDISNYLNWYQQKPGKAPKLLIYAASTLQSGVPSRFSGSGSGTDFTLTISSLQPEDFATYYCQQSYSIPFTFGPGTKVDIKR

SEQ ID NO: 525 - protein, 108 aa, Homo sapiens
DIQMTQSPSSLSASVGDRVTITCRASQSINRFLNWYQQKPGKAPKLLIYAASSLQNGVPSRFSGSGSGTDFTLTISSLQPEDFATYYCQQSYSTPYTFGQGTKVEIKR

SEQ ID NO: 526 - protein, 108 aa, Homo sapiens
DIQMTQSPSSLSASVGDRVTITCQASQDISNYLNWYQQKPGKAPKLLIYAASTLQSGVPSRFSGSGSGTDFTLTISSLQPEDFATYYCQQSYSTPITFGQGTRLEIKR

SEQ ID NO: 527 - protein, 108 aa, Homo sapiens
DIQMTQSPSSLSASVGDRVTITCRASQSVSTYLNWYQQKPGKAPKLLIYAASSLQSGVPSRFSGSGSGTDFTLTISSLQPEDFATYYCQQSYTIPSTFGQGTKVEIKR

SEQ ID NO: 528 - protein, 108 aa, Homo sapiens
DIQMTQSPSSLSASVGDRVTITCQASQDIAKYLNWYQQKPGKAPKLLIYAASSLQSGVPSRFSGSGSGTDFTLTISSLQPEDFATYYCQQSYSAPPTFGGGTKVEIKR

SEQ ID NO: 529 - protein, 108 aa, Homo sapiens
DIQMTQSPSSLSASVGDRVTITCQASQGITNYLNWYQQKPGKAPKLLIYGASSLQSGVPSRFSGSGSGTDFTLTISSLQPEDFATYYCQQSYSTPWTFGPGTKVDIKR

SEQ ID NO: 530 - protein, 108 aa, Homo sapiens
DIQMTQSPSSLSASVGDRVTITCQASQDIHNYLNWYQQKPGKAPKLLIYAASTLQSGVPSRFSGSGSGTDFTLTISSLQPEDFATYYCQQSYTTPLTFGQGTKVEIKR

SEQ ID NO: 531 - protein, 108 aa, Homo sapiens
DIQMTQSPSSLSASVGDRVTITCQASQDISNYLNWYQQKPGKAPKLLIYSAFSLQSGVPSRFSGSGSGTDFTLTISSLQPEDFATYYCQQSYSAPITFGQGTRLEIKR

SEQ ID NO: 532 - protein, 109 aa, Homo sapiens
DIQMTQSPSSLSASVGDRVTITCRASQSISSYLNWYQQKPGKAPKLLIYSASNLQSGVPSRFSGSGSGTDFTLTISSLQPEDFATYYCQQRSNWPPVTFGQGTKVEIKR

SEQ ID NO: 533 - protein, 108 aa, Homo sapiens
DIQMTQSPSSLSASVGDRVTITCQANQDISNFLEWYQQKPGKAPKLLIYDASSLESGVPSRFSGSGSGTDFTLTISSLQPEDFATYYCQQSYSIPITFGQGTRLEIKR

SEQ ID NO: 534 - protein, 108 aa, Homo sapiens
DIQMTQSPSSLSASVGDRVTITCRASQGISNNLNWYQQKPGKAPKLLIYEASTLESGVPSRFSGSGSGTDFTLTISSLQPEDFATYYCQQSYSTPLTFGGGTKVEIKR

SEQ ID NO: 535 - protein, 113 aa, Homo sapiens
DIVMTQSPLSLPVTPGEPASISCRSSQSLLHSNGYNYLDWYLQKPGQSPQLLIYGASTLETGVPDRFSGSGSGTDFTLKISRVEAEDVGVYYCMQGLQPPGTFGQGTKVEIKR

SEQ ID NO: 536 - protein, 108 aa, Homo sapiens
DIQMTQSPSSLSASVGDRVTITCRASQSISRSLVWYQQKPGKAPKLLIYAASTLQTGVPSRFSGSGSGTDFTLTISSLQPEDFATYYCQQSYNHFRTFGPGTKVDIKR

SEQ ID NO: 537 - protein, 108 aa, Homo sapiens
DIQMTQSPSSLSASVGDRVTITCQASQDISNYLNWYQQKPGKAPKLLIYDASNLETGVPSRFSGSGSGTDFTLTISSLQPEDFATYYCQRSDSTPLTFGGGTKVEIKR

SEQ ID NO: 538 - protein, 108 aa, Homo sapiens
DIQMTQSPSSLSASVGDRVTITCQASHDISKSLNWYQQKPGKAPKLLIYGASTLQSGVPSRFSGSGSGTDFTLTISSLQPEDFATYYCQQLNSYPRTFGGGTKVEIKR

SEQ ID NO: 539 - protein, 108 aa, Homo sapiens
DIQMTQSPSSLSASVGDRVTITCRASQDIGAYLAWYQQKPGKAPKLLIYAASSLQSGVPSRFSGSGSGTDFTLTISSLQPEDFATYYCQQSYSIPYTFGQGTKLEIKR

SEQ ID NO: 540 - protein, 108 aa, Homo sapiens
DIQMTQSPSSLSASVGDRVTITCRASQSISSYLAWYQQKPGKAPKLLIYAASSLQSGVPSRFSGSGSGTDFTLTISSLQPEDFATYYCQQSYSTPYTFGQGTKLEIKR

SEQ ID NO: 541 - protein, 108 aa, Homo sapiens
DIQMTQSPSSLSASVGDRVTITCRASQGIRSYLAWYQQKPGKAPKLLIYGASNLETGVPSRFSGSGSGTDFTLTISSLQPEDFATYYCQQSYSTPYTFGQGTKLEIKR

SEQ ID NO: 542 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQTYSTPYTFGQGTKLEIKR

SEQ ID NO: 543 - protein, 108 aa, Homo sapiens
DIQMTQSPSSLSASVGDRVTITCRASQNIGTWLAWYQQKPGKAPKLLIYAASTLQSGVPSRFSGSGSGTDFTLTISSLQPEDFATYYCQQSYSTPQTFGPGTKVDIKR

SEQ ID NO: 544 - protein, 108 aa, Homo sapiens
DIQMTQSPSSLSASVGDRVTITCRASQTISYYLNWYQQKPGKAPKLLIYAASTLQSGVPSRFSGSGSGTDFTLTISSLQPEDFATYYCQQSYRTPYTFGQGTKLEIKR

SEQ ID NO: 545 - protein, 112 aa, Homo sapiens
DIVMTQSPLSLPVTPGEPASISCRSSQSLLHSNGYNYLDWYLQKPGQSPQLLIYMGSNRASGVPDRFSGSGSGTDFTLKISRVEAEDVGVYYCMQGTHWPTFGQGTRLEIKR

SEQ ID NO: 546 - protein, 108 aa, Homo sapiens
DIQMTQSPSSLSASVGDRVTITCRASQNINNYLNWYQQKPGKAPKLLIYGASSLQSGVPSRFSGSGSGTDFTLTISSLQPEDFATYYCQQTFSLPYTFGQGTKVEIKR

SEQ ID NO: 547 - protein, 108 aa, Homo sapiens
DIQMTQSPSSLSASVGDRVTITCRASQTISTYLNWYQQKPGKAPKLLIYDASNLETGVPSRFSGSGSGTDFTLTISSLQPEDFATYYCQQSYSTPYTFGQGTKLEIKR

SEQ ID NO: 548 - protein, 108 aa, Homo sapiens
DIQMTQSPSSLSASVGDRVTITCRASRGIGNDLAWYQQKPGKAPKLLIYDASTLETGVPSRFSGSGSGTDFTLTISSLQPEDFATYYCQQGYNMPLTFGGGTKVEIKR

SEQ ID NO: 549 - protein, 108 aa, Homo sapiens
DIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGGGTKVEIKR

SEQ ID NO: 550 - protein, 108 aa, Homo sapiens
DIQMTQSPSSLSASVGDRVTITCRASQFIGSWLAWYQQKPGKAPKLLIYAASTLQSGVPSRFSGSGSGTDFTLTISSLQPEDFATYYCQQSYSFPWTFGQGTKVEIKR

SEQ ID NO: 551 - protein, 108 aa, Homo sapiens
DIQMTQSPSSLSASVGDRVTITCRASQSISSWMAWYQQKPGKAPKLLIYDASNLETGVPSRFSGSGSGTDFTLTISSLQPEDFATYYCQQTYSTPYIFGQGTKVEIKR

SEQ ID NO: 552 - protein, 108 aa, Homo sapiens
DIQMTQSPSSLSASVGDRVTITCRASQGISNNLNWYQQKPGKAPKLLIYDASNLETGVPSRFSGSGSGTDFTLTISSLQPEDFATYYCQQSYSSPWTFGQGTKVEIKR

SEQ ID NO: 553 - protein, 114 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYASAPRTFGQGTKLEIKR

SEQ ID NO: 554 - protein, 108 aa, Homo sapiens
DIQMTQSPSSLSASVGDRVTITCRASQSISSYLNWYQQKPGKAPKLLIYKTSSLESGVPSRFSGSGSGTDFTLTISSLQPEDFATYYCQQSFTIPYTFGQGTKVEIKR

SEQ ID NO: 555 - protein, 108 aa, Homo sapiens
DIQMTQSPSSLSASVGDRVTITCRVSQGISSYLNWYQQKPGKAPKLLIYGASSLQSGVPSRFSGSGSGTDFTLTISSLQPEDFATYYCQQSYSTPLTFGGGTKVEIKR

SEQ ID NO: 556 - protein, 108 aa, Homo sapiens
DIQMTQSPSSLSASVGDRVTITCRASQSISDWLAWYQQKPGKAPKLLIYDASNLETGVPSRFSGSGSGTDFTLTISSLQPEDFATYYCQQSYSTPLTFGGGTKVEIKR

SEQ ID NO: 557 - protein, 108 aa, Homo sapiens
DIQMTQSPSSLSASVGDRVTITCRASQGISNYLAWYQQKPGKAPKLLIYSASNLQSGVPSRFSGSGSGTDFTLTISSLQPEDFATYYCQQTYRTPPTFGPGTKVDIKR

SEQ ID NO: 558 - protein, 108 aa, Homo sapiens
DIQMTQSPSSLSASVGDRVTITCRASQSIRNYLTWYQQKPGKAPKLLIYSASNLQSGVPSRFSGSGSGTDFTLTISSLQPEDFATYYCQQSYSTPLTFGQGTKVEIKR

SEQ ID NO: 559 - protein, 108 aa, Homo sapiens
DIQMTQSPSSLSASVGDRVTITCRASQNIRLYLNWYQQKPGKAPKLLIYAASTLQSGVPSRFSGSGSGTDFTLTISSLQPEDFATYYCQQSLTTPFTFGPGTKVDIKR

SEQ ID NO: 560 - protein, 108 aa, Homo sapiens
DIQMTQSPSSLSASVGDRVTITCQASQDIRKFLNWYQQKPGKAPKLLIYAASSLQSGVPSRFSGSGSGTDFTLTISSLQPEDFATYYCQQLNGYPGTFGQGTRLEIKR

SEQ ID NO: 561 - protein, 108 aa, Homo sapiens
DIQMTQSPSSLSASVGDRVTITCRASQSISSYLNWYQQKPGKAPKLLIYTASNLQSGVPSRFSGSGSGTDFTLTISSLQPEDFATYYCQQSYSLPLTFGGGTKVEIKR

SEQ ID NO: 562 - protein, 108 aa, Homo sapiens
DIQMTQSPSSLSASVGDRVTITCQASQDISNYLSWYQQKPGKAPKLLIYDASNLQSGVPSRFSGSGSGTDFTLTISSLQPEDFATYYCQQTYTTPRTFGPGTKVDIKR

SEQ ID NO: 563 - protein, 108 aa, Homo sapiens
DIQMTQSPSSLSASVGDRVTITCRASQNVRSWLAWYQQKPGKAPKLLIYAASSLQSGVPSRFSGSGSGTDFTLTISSLQPEDFATYYCQQSYNTPYTFGQGTKLEIKR

SEQ ID NO: 564 - protein, 108 aa, Homo sapiens
DIQMTQSPSSLSASVGDRVTITCRASQGIGNDLGWYQQKPGKAPKLLIYAASSLQSGVPSRFSGSGSGTDFTLTISSLQPEDFATYYCQQSYAPPPTFGQGTKVEIKR

SEQ ID NO: 565 - protein, 108 aa, Homo sapiens
DIQMTQSPSSLSASVGDRVTITCRASQSISNWLAWYQQKPGKAPKLLIYGASNLETGVPSRFSGSGSGTDFTLTISSLQPEDFATYYCQQSYSTPPTFGQGTKLEIKR

SEQ ID NO: 566 - protein, 113 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPLTFGQGTKVEIKR

SEQ ID NO: 567 - protein, 108 aa, Homo sapiens
DIQMTQSPSSLSASVGDRVTITCRASQSISSYLNWYQQKPGKAPKLLIYLASSLQSGVPSRFSGSGSGTDFTLTISSLQPEDFATYYCQQSDSIPVTFGQGTKVEIKR

SEQ ID NO: 568 - protein, 108 aa, Homo sapiens
DIQMTQSPSSLSASVGDRVTITCQASQDISNYLNWYQQKPGKAPKLLIYSTSSLQSGVPSRFSGSGSGTDFTLTISSLQPEDFATYYCQQSYSTPYNFGQGTKLEIKR

SEQ ID NO: 569 - protein, 108 aa, Homo sapiens
DIQMTQSPSSLSASVGDRVTITCRASESIGSWLAWYQQKPGKAPKLLIYAASSLQSGVPSRFSGSGSGTDFTLTISSLQPEDFATYYCQQSYSTPYTFGQGTKLEIKR

SEQ ID NO: 570 - protein, 108 aa, Homo sapiens
DIQMTQSPSSLSASVGDRVTITCRASQSISNYLNWYQQKPGKAPKLLIYAASSLQRGVPSRFSGSGSGTDFTLTISSLQPEDFATYYCQQSYSTPLTFGQGTKVEIKR

SEQ ID NO: 571 - protein, 108 aa, Homo sapiens
EIVMTQSPATLSVSPGERATLSCRASQSVTSNYLAWYQQKPGQAPRLLIYGASTRATGIPARFSGSGSGTEFTLTISSLQSEDFAVYYCQHYGSSPAFGQGTRLEIKR

SEQ ID NO: 572 - protein, 108 aa, Homo sapiens
DIQMTQSPSSLSASVGDRVTITCRASQGISSYLAWYQQKPGKAPKLLIYAASTLQSGVPSRFSGSGSGTDFTLTISSLQPEDFATYYCQQSYSTPPTFGPGTKVDIKR

SEQ ID NO: 573 - protein, 108 aa, Homo sapiens
DIQMTQSPSSLSASVGDRVTITCRASQDIGNYLNWYQQKPGKAPKLLIYAASSLQSGVPSRFSGSGSGTDFTLTISSLQPEDFATYYCQQAYTYPYTFGQGTKLEIKR

SEQ ID NO: 574 - protein, 108 aa, Homo sapiens
DIQMTQSPSSLSASVGDRVTITCQASQDISNYLNWYQQKPGKAPKLLIYGASSLQSGVPSRFSGSGSGTDFTLTISSLQPEDFATYYCQQSYTTPNTFGPGTKVDIKR

SEQ ID NO: 575 - protein, 108 aa, Homo sapiens
DIQMTQSPSSLSASVGDRVTITCRASQGISNYLAWYQQKPGKAPKLLIYAASTLQSGVPSRFSGSGSGTDFTLTISSLQPEDFATYYCQQSYSTPYTFGQGTKVEIKR

SEQ ID NO: 576 - protein, 108 aa, Homo sapiens
DIQMTQSPSSLSASVGDRVTITCRASQGISNGLSWYQQKPGKAPKLLIYDASNLETGVPSRFSGSGSGTDFTLTISSLQPEDFATYYCQQSYSTPFTFGPGTKVDIKR

SEQ ID NO: 577 - protein, 108 aa, Homo sapiens
DIQMTQSPSSLSASVGDRVTITCRASQNIRNYLNWYQQKPGKAPKLLIYGASSLQSGVPSRFSGSGSGTDFTLTISSLQPEDFATYYCQQSYSTPLTFGGGTKVEIKR

SEQ ID NO: 578 - protein, 108 aa, Homo sapiens
DIQMTQSPSSLSASVGDRVTITCQASLDINNYLNWYQQKPGKAPKLLIYKASSLESGVPSRFSGSGSGTDFTLTISSLQPEDFATYYCQQSYSMPLTFGPGTKVDIKR

SEQ ID NO: 579 - protein, 108 aa, Homo sapiens
DIQMTQSPSSLSASVGDRVTITCQASQDISNYLNWYQQKPGKAPKLLIYAASSLQGGVPSRFSGSGSGTDFTLTISSLQPEDFATYYCQQSYTTPWTFGQGTKLEIKR

SEQ ID NO: 580 - protein, 108 aa, Homo sapiens
DIQMTQSPSSLSASVGDRVTITCQASQDISNYLNWYQQKPGKAPKLLIYAASSLQSGVPSRFSGSGSGTDFTLTISSLQPEDFATYYCQQSYSSPLTFGGGTKVEIKR

SEQ ID NO: 581 - protein, 108 aa, Homo sapiens
DIQMTQSPSSLSASVGDRVTITCQASQDISNYLNWYQQKPGKAPKLLIYKASSLESGVPSRFSGSGSGTDFTLTISSLQPEDFATYYCQQSYSDPLTFGQGTKVEIKR

SEQ ID NO: 582 - protein, 108 aa, Homo sapiens
DIQMTQSPSSLSASVGDRVTITCQASQDISNYLNWYQQKPGKAPKLLIYGASTLQSGVPSRFSGSGSGTDFTLTISSLQPEDFATYYCQQSYSAPITFGQGTRLEIKR

SEQ ID NO: 583 - protein, 108 aa, Homo sapiens
DIQMTQSPSSLSASVGDRVTITCRASQSISNYLNWYQQKPGKAPKLLIYAASNLQSGVPSRFSGSGSGTDFTLTISSLQPEDFATYYCQQSYTTPLTFGPGTKVDIKR

SEQ ID NO: 584 - protein, 109 aa, Homo sapiens
DIQMTQSPSSLSASVGDRVTITCRASQNIGNYLNWYQQKPGKAPKLLIYAASTLQSGVPSRFSGSGSGTDFTLTISSLQPEDFATYYCQQSYSTPPWTFGQGTKVEIKR

SEQ ID NO: 585 - protein, 108 aa, Homo sapiens
DIQMTQSPSSLSASVGDRVTITCQASQDISNYLNWYQQKPGKAPKLLIYAASTLRSGVPSRFSGSGSGTDFTLTISSLQPEDFATYYCQQSYQTPLTFGGGTKVEIKR

SEQ ID NO: 586 - protein, 108 aa, Homo sapiens
DIQMTQSPSSLSASVGDRVTITCQASQDISNYLNWYQQKPGKAPKLLIYAASTLQSGVPSRFSGSGSGTDFTLTISSLQPEDFATYYCQQSYTTPPTFGQGTKVEIKR

SEQ ID NO: 587 - protein, 108 aa, Homo sapiens
DIQMTQSPSSLSASVGDRVTITCQASQDISNYLNWYQQKPGKAPKLLIYAASSLHSGVPSRFSGSGSGTDFTLTISSLQPEDFATYYCQQSYSTPQTFGQGTKVEIKR

SEQ ID NO: 588 - protein, 108 aa, Homo sapiens
DIQMTQSPSSLSASVGDRVTITCRASQGIRNDLNWYQQKPGKAPKLLIYAASNLQSGVPSRFSGSGSGTDFTLTISSLQPEDFATYYCQQANSFPITFGQGTKLEIKR

SEQ ID NO: 589 - protein, 108 aa, Homo sapiens
DIQMTQSPSSLSASVGDRVTITCRASQGINTWLAWYQQKPGKAPKLLIYAASSLQSGVPSRFSGSGSGTDFTLTISSLQPEDFATYYCQQSYSTPYTFGQGTRLEIKR

SEQ ID NO: 590 - protein, 108 aa, Homo sapiens
DIQMTQSPSSLSASVGDRVTITCQASQDISNYLNWYQQKPGKAPKLLIYAASTLQSGVPSRFSGSGSGTDFTLTISSLQPEDFATYYCQQSYTVPPTFGQGTKVEIKR

SEQ ID NO: 591 - protein, 108 aa, Homo sapiens
DIQMTQSPSSLSASVGDRVTITCQASQDIRYFLNWYQQKPGKAPKLLIYAASTLQSGVPSRFSGSGSGTDFTLTISSLQPEDFATYYCQQDDSFPLTFGGGTKVEIKR

SEQ ID NO: 592 - protein, 546 aa, Nipah henipavirus
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 593 - protein, 520 aa, Nipah henipavirus
ILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 594 - protein, 83 aa, Nipah henipavirus
ILHYEKLSKIGLVKGVTRKYKIKSNPLTKDIVIKMIPNVSNMSQCTGSVMENYKTRLNGILTPIKGALEIYKNNTHDLVGDVR

SEQ ID NO: 595 - protein, 437 aa, Nipah henipavirus
LAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 596 - protein, 500 aa, Artificial Sequence
  Description of Artificial Sequence: Synthetic polypeptide
ILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTGT

SEQ ID NO: 597 - protein, 417 aa, Artificial Sequence
  Description of Artificial Sequence: Synthetic polypeptide
LAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTGT

SEQ ID NO: 598 - protein, 500 aa, Artificial Sequence
  Description of Artificial Sequence: Synthetic polypeptide
ILHYEKLSKIGLVKGVTRKYKIKSNPLTKDIVIKMIPNVSNMSQCTGSVMENYKTRLNGILTPIKGALEIYKNQTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTGT

SEQ ID NO: 599 - protein, 524 aa, Artificial Sequence
  Description of Artificial Sequence: Synthetic polypeptide
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNT

SEQ ID NO: 600 - protein, 602 aa, Nipah henipavirus
MGPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 601 - protein, 597 aa, Artificial Sequence
  Description of Artificial Sequence: Synthetic polypeptide
MGKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 602 - protein, 592 aa, Artificial Sequence
  Description of Artificial Sequence: Synthetic polypeptide
MGNTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 603 - protein, 587 aa, Artificial Sequence
  Description of Artificial Sequence: Synthetic polypeptide
MGKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 604 - protein, 582 aa, Artificial Sequence
  Description of Artificial Sequence: Synthetic polypeptide
MGSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 605 - protein, 577 aa, Artificial Sequence
  Description of Artificial Sequence: Synthetic polypeptide
MGSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 606 - protein, 573 aa, Artificial Sequence
  Description of Artificial Sequence: Synthetic polypeptide
MGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 607 - protein, 569 aa, Artificial Sequence
  Description of Artificial Sequence: Synthetic polypeptide
MKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCT

SEQ ID NO: 608 - protein, 546 aa, Hendra henipavirus
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 609 - protein, 604 aa, Hendra henipavirus
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 610 - protein, 526 aa, Artificial Sequence
  Description of Artificial Sequence: Synthetic polypeptide
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTGT

SEQ ID NO: 611 - protein, 526 aa, Artificial Sequence
  Description of Artificial Sequence: Synthetic polypeptide
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNQTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTGT

SEQ ID NO: 612 - protein, 569 aa, Artificial Sequence
  Description of Artificial Sequence: Synthetic polypeptide
MKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 613 - protein, 498 aa, Artificial Sequence
  Description of Artificial Sequence: Synthetic polypeptide
ILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNT

SEQ ID NO: 614 - protein, 557 aa, Cedar henipavirus
MSNKRTTVLIIISYTLFYLNNAAIVGFDFDKLNKIGVVQGRVLNYKIKGDPMTKDLVLKFIPNIVNITECVREPLSRYNETVRRLLLPIHNMLGLYLNNTNAKMTGLMIAGVIMGGIAIGIATAAQITAGFALYEAKKNTENIQKLTDSIMKTQDSIDKLTDSVGTSILILNKLQTYINNQLVPNLELLSCRQNKIEFDLMLTKYLVDLMTVIGPNINNPVNKDMTIQSLSLLFDGNYDIMMSELGYTPQDFLDLIESKSITGQIIYVDMENLYVVIRTYLPTLIEVPDAQIYEFNKITMSSNGGEYLSTIPNFILIRGNYMSNIDVATCYMTKASVICNQDYSLPMSQNLRSCYQGETEYCPVEAVIASHSPRFALTNGVIFANCINTICRCQDNGKTITQNINQFVSMIDNSTCNDVMVDKFTIKVGKYMGRKDINNINIQIGPQIIIDKVDLSNEINKMNQSLKDSIFYLREAKRILDSVNISLISPSVQLFLIIISVLSFIILLIIIVYLYCKSKHSYKYNKFIDDPDYYNDYKRERINGKASKSNNIYYVGD

SEQ ID NO: 615 - protein, 545 aa, Mojiang henipavirus
MALNKNMFSSLFLGYLLVYATTVQSSIHYDSLSKVGVIKGLTYNYKIKGSPSTKLMVVKLIPNIDSVKNCTQKQYDEYKNLVRKALEPVKMAIDTMLNNVKSGNNKYRFAGAIMAGVALGVATAATVTAGIALHRSNENAQAIANMKSAIQNTNEAVKQLQLANKQTLAVIDTIRGEINNNIIPVINQLSCDTIGLSVGIRLTQYYSEIITAFGPALQNPVNTRITIQAISSVFNGNFDELLKIMGYTSGDLYEILHSELIRGNIIDVDVDAGYIALEIEFPNLTLVPNAVVQELMPISYNIDGDEWVTLVPRFVLTRTTLLSNIDTSRCTITDSSVICDNDYALPMSHELIGCLQGDTSKCAREKVVSSYVPKFALSDGLVYANCLNTICRCMDTDTPISQSLGATVSLLDNKRCSVYQVGDVLISVGSYLGDGEYNADNVELGPPIVIDKIDIGNQLAGINQTLQEAEDYIEKSEEFLKGVNPSIITLGSMVVLYIFMILIAIVSVIALVLSIKLTVKGNVVRQQFTYTQHVPSMENINYVSH

SEQ ID NO: 616 - protein, 662 aa, Unknown
  Description of Unknown: Bat Paramyxovirus Eid_hel/GH-M74a/GHA/2009 sequence
MKKKTDNPTISKRGHNHSRGIKSRALLRETDNYSNGLIVENLVRNCHHPSKNNLNYTKTQKRDSTIPYRVEERKGHYPKIKHLIDKSYKHIKRGKRRNGHNGNIITIILLLILILKTQMSEGAIHYETLSKIGLIKGITREYKVKGTPSSKDIVIKLIPNVTGLNKCTNISMENYKEQLDKILIPINNIIELYANSTKSAPGNARFAGVIIAGVALGVAAAAQITAGIALHEARQNAERINLLKDSISATNNAVAELQEATGGIVNVITGMQDYINTNLVPQIDKLQCSQIKTALDISLSQYYSEILTVFGPNLQNPVTTSMSIQAISQSFGGNIDLLLNLLGYTANDLLDLLESKSITGQITYINLEHYFMVIRVYYPIMTTISNAYVQELIKISFNVDGSEWVSLVPSYILIRNSYLSNIDISECLITKNSVICRHDFAMPMSYTLKECLTGDTEKCPREAVVTSYVPRFAISGGVIYANCLSTTCQCYQTGKVIAQDGSQTLMMIDNQTCSIVRIEEILISTGKYLGSQEYNTMHVSVGNPVFTDKLDITSQISNINQSIEQSKFYLDKSKAILDKINLNLIGSVPISILFIIAILSLILSIITFVIVMIIVRRYNKYTPLINSDPSSRRSTIQDVYIIPNPGEHSIRSAARSIDRDRD

SEQ ID NO: 617 - protein, 5 aa, Homo sapiens
RYAIS

SEQ ID NO: 618 - protein, 602 aa, Nipah henipavirus
MPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 619 - protein, 622 aa, Cedar henipavirus
MLSQLQKNYLDNSNQQGDKMNNPDKKLSVNFNPLELDKGQKDLNKSYYVKNKNYNVSNLLNESLHDIKFCIYCIFSLLIIITIINIITISIVITRLKVHEENNGMESPNLQSIQDSLSSLTNMINTEITPRIGILVTATSVTLSSSINYVGTKTNQLVNELKDYITKSCGFKVPELKLHECNISCADPKISKSAMYSTNAYAELAGPPKIFCKSVSKDPDFRLKQIDYVIPVQQDRSICMNNPLLDISDGFFTYIHYEGINSCKKSDSFKVLLSHGEIVDRGDYRPSLYLLSSHYHPYSMQVINCVPVTCNQSSFVFCHISNNTKTLDNSDYSSDEYYITYFNGIDRPKTKKIPINNMTADNRYIHFTFSGGGGVCLGEEFIIPVTTVINTDVFTHDYCESFNCSVQTGKSLKEICSESLRSPTNSSRYNLNGIMIISQNNMTDFKIQLNGITYNKLSFGSPGRLSKTLGQVLYYQSSMSWDTYLKAGFVEKWKPFTPNWMNNTVISRPNQGNCPRYHKCPEICYGGTYNDIAPLDLGKDMYVSVILDSDQLAENPEITVFNSTTILYKERVSKDELNTRSTTTSCFLFLDEPWCISVLETNRFNGKSIRPEIYSYKIPKYC

SEQ ID NO: 620 - protein, 632 aa, Unknown
  Description of Unknown: Bat Paramyxovirus Eid_hel/GH-M74a/GHA/2009 sequence
MPQKTVEFINMNSPLERGVSTLSDKKTLNQSKITKQGYFGLGSHSERNWKKQKNQNDHYMTVSTMILEILVVLGIMFNLIVLTMVYYQNDNINQRMAELTSNITVLNLNLNQLTNKIQREIIPRITLIDTATTITIPSAITYILATLTTRISELLPSINQKCEFKTPTLVLNDCRINCTPPLNPSDGVKMSSLATNLVAHGPSPCRNFSSVPTIYYYRIPGLYNRTALDERCILNPRLTISSTKFAYVHSEYDKNCTRGFKYYELMTFGEILEGPEKEPRMFSRSFYSPTNAVNYHSCTPIVTVNEGYFLCLECTSSDPLYKANLSNSTFHLVILRHNKDEKIVSMPSFNLSTDQEYVQIIPAEGGGTAESGNLYFPCIGRLLHKRVTHPLCKKSNCSRTDDESCLKSYYNQGSPQHQVVNCLIRIRNAQRDNPTWDVITVDLTNTYPGSRSRIFGSFSKPMLYQSSVSWHTLLQVAEITDLDKYQLDWLDTPYISRPGGSECPFGNYCPTVCWEGTYNDVYSLTPNNDLFVTVYLKSEQVAENPYFAIFSRDQILKEFPLDAWISSARTTTISCFMFNNEIWCIAALEITRLNDDIIRPIYYSFWLPTDCRTPYPHTGKMTRVPLRSTYNY

SEQ ID NO: 621 - protein, 625 aa, Mojiang henipavirus
MATNRDNTITSAEVSQEDKVKKYYGVETAEKVADSISGNKVFILMNTLLILTGAIITITLNITNLTAAKSQQNMLKIIQDDVNAKLEMFVNLDQLVKGEIKPKVSLINTAVSVSIPGQISNLQTKFLQKYVYLEESITKQCTCNPLSGIFPTSGPTYPPTDKPDDDTTDDDKVDTTIKPIEYPKPDGCNRTGDHFTMEPGANFYTVPNLGPASSNSDECYTNPSFSIGSSIYMFSQEIRKTDCTAGEILSIQIVLGRIVDKGQQGPQASPLLVWAVPNPKIINSCAVAAGDEMGWVLCSVTLTAASGEPIPHMFDGFWLYKLEPDTEVVSYRITGYAYLLDKQYDSVFIGKGGGIQKGNDLYFQMYGLSRNRQSFKALCEHGSCLGTGGGGYQVLCDRAVMSFGSEESLITNAYLKVNDLASGKPVIIGQTFPPSDSYKGSNGRMYTIGDKYGLYLAPSSWNRYLRFGITPDISVRSTTWLKSQDPIMKILSTCTNTDRDMCPEICNTRGYQDIFPLSEDSEYYTYIGITPNNGGTKNFVAVRDSDGHIASIDILQNYYSITSATISCFMYKDEIWCIAITEGKKQKDNPQRIYAHSYKIRQMCYNMKSATVTVGNAKNITIRRY

SEQ ID NO: 622 - protein, 552 aa, Hendra henipavirus
FNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 623 - protein, 555 aa, Hendra henipavirus
FNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 624 - protein, 26 aa, Nipah henipavirus
MVVILDKRCYCNLLILILMISECSVG

SEQ ID NO: 625 - protein, 6 aa, Artificial Sequence
  Description of Artificial Sequence: Synthetic peptide
GGGGGS

SEQ ID NO: 626 - protein, 50 aa, Artificial Sequence
  Description of Artificial Sequence: Synthetic polypeptide
  SITE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 627 - protein, 5 aa, Artificial Sequence
  Description of Artificial Sequence: Synthetic peptide
GGGGS

SEQ ID NO: 628 - protein, 600 aa, Nipah henipavirus
PAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 629 - protein, 595 aa, Artificial Sequence
  Description of Artificial Sequence: Synthetic polypeptide
KVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 630 - protein, 590 aa, Artificial Sequence
  Description of Artificial Sequence: Synthetic polypeptide
NTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 631 - protein, 585 aa, Artificial Sequence
  Description of Artificial Sequence: Synthetic polypeptide
KGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 632 - protein, 580 aa, Artificial Sequence
  Description of Artificial Sequence: Synthetic polypeptide
SKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 633 - protein, 575 aa, Artificial Sequence
  Description of Artificial Sequence: Synthetic polypeptide
SYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 634 - protein, 571 aa, Artificial Sequence
  Description of Artificial Sequence: Synthetic polypeptide
TMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQC

SEQ ID NO: 635 - protein, 568 aa, Artificial Sequence
  Description of Artificial Sequence: Synthetic polypeptide
KKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCT

SEQ ID NO: 636 - protein, 603 aa, Hendra henipavirus
MADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 637 - protein, 568 aa, Artificial Sequence
  Description of Artificial Sequence: Synthetic polypeptide
KKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 638 - protein, 621 aa, Cedar henipavirus
LSQLQKNYLDNSNQQGDKMNNPDKKLSVNFNPLELDKGQKDLNKSYYVKNKNYNVSNLLNESLHDIKFCIYCIFSLLIIITIINIITISIVITRLKVHEENNGMESPNLQSIQDSLSSLTNMINTEITPRIGILVTATSVTLSSSINYVGTKTNQLVNELKDYITKSCGFKVPELKLHECNISCADPKISKSAMYSTNAYAELAGPPKIFCKSVSKDPDFRLKQIDYVIPVQQDRSICMNNPLLDISDGFFTYIHYEGINSCKKSDSFKVLLSHGEIVDRGDYRPSLYLLSSHYHPYSMQVINCVPVTCNQSSFVFCHISNNTKTLDNSDYSSDEYYITYFNGIDRPKTKKIPINNMTADNRYIHFTFSGGGGVCLGEEFIIPVTTVINTDVFTHDYCESFNCSVQTGKSLKEICSESLRSPTNSSRYNLNGIMIISQNNMTDFKIQLNGITYNKLSFGSPGRLSKTLGQVLYYQSSMSWDTYLKAGFVEKWKPFTPNWMNNTVISRPNQGNCPRYHKCPEICYGGTYNDIAPLDLGKDMYVSVILDSDQLAENPEITVFNSTTILYKERVSKDELNTRSTTTSCFLFLDEPWCISVLETNRFNGKSIRPEIYSYKIPKYC

SEQ ID NO: 639 - protein, 631 aa, Unknown
  Description of Unknown: Bat Paramyxovirus Eid_hel/GH-M74a/GHA/2009 sequence
PQKTVEFINMNSPLERGVSTLSDKKTLNQSKITKQGYFGLGSHSERNWKKQKNQNDHYMTVSTMILEILVVLGIMFNLIVLTMVYYQNDNINQRMAELTSNITVLNLNLNQLTNKIQREIIPRITLIDTATTITIPSAITYILATLTTRISELLPSINQKCEFKTPTLVLNDCRINCTPPLNPSDGVKMSSLATNLVAHGPSPCRNFSSVPTIYYYRIPGLYNRTALDERCILNPRLTISSTKFAYVHSEYDKNCTRGFKYYELMTFGEILEGPEKEPRMFSRSFYSPTNAVNYHSCTPIVTVNEGYFLCLECTSSDPLYKANLSNSTFHLVILRHNKDEKIVSMPSFNLSTDQEYVQIIPAEGGGTAESGNLYFPCIGRLLHKRVTHPLCKKSNCSRTDDESCLKSYYNQGSPQHQVVNCLIRIRNAQRDNPTWDVITVDLTNTYPGSRSRIFGSFSKPMLYQSSVSWHTLLQVAEITDLDKYQLDWLDTPYISRPGGSECPFGNYCPTVCWEGTYNDVYSLTPNNDLFVTVYLKSEQVAENPYFAIFSRDQILKEFPLDAWISSARTTTISCFMFNNEIWCIAALEITRLNDDIIRPIYYSFWLPTDCRTPYPHTGKMTRVPLRSTYNY

SEQ ID NO: 640 - protein, 624 aa, Mojiang henipavirus
ATNRDNTITSAEVSQEDKVKKYYGVETAEKVADSISGNKVFILMNTLLILTGAIITITLNITNLTAAKSQQNMLKIIQDDVNAKLEMFVNLDQLVKGEIKPKVSLINTAVSVSIPGQISNLQTKFLQKYVYLEESITKQCTCNPLSGIFPTSGPTYPPTDKPDDDTTDDDKVDTTIKPIEYPKPDGCNRTGDHFTMEPGANFYTVPNLGPASSNSDECYTNPSFSIGSSIYMFSQEIRKTDCTAGEILSIQIVLGRIVDKGQQGPQASPLLVWAVPNPKIINSCAVAAGDEMGWVLCSVTLTAASGEPIPHMFDGFWLYKLEPDTEVVSYRITGYAYLLDKQYDSVFIGKGGGIQKGNDLYFQMYGLSRNRQSFKALCEHGSCLGTGGGGYQVLCDRAVMSFGSEESLITNAYLKVNDLASGKPVIIGQTFPPSDSYKGSNGRMYTIGDKYGLYLAPSSWNRYLRFGITPDISVRSTTWLKSQDPIMKILSTCTNTDRDMCPEICNTRGYQDIFPLSEDSEYYTYIGITPNNGGTKNFVAVRDSDGHIASIDILQNYYSITSATISCFMYKDEIWCIAITEGKKQKDNPQRIYAHSYKIRQMCYNMKSATVTVGNAKNITIRRY

SEQ ID NO: 641 - protein, 530 aa, Cedar henipavirus
DFDKLNKIGVVQGRVLNYKIKGDPMTKDLVLKFIPNIVNITECVREPLSRYNETVRRLLLPIHNMLGLYLNNTNAKMTGLMIAGVIMGGIAIGIATAAQITAGFALYEAKKNTENIQKLTDSIMKTQDSIDKLTDSVGTSILILNKLQTYINNQLVPNLELLSCRQNKIEFDLMLTKYLVDLMTVIGPNINNPVNKDMTIQSLSLLFDGNYDIMMSELGYTPQDFLDLIESKSITGQIIYVDMENLYVVIRTYLPTLIEVPDAQIYEFNKITMSSNGGEYLSTIPNFILIRGNYMSNIDVATCYMTKASVICNQDYSLPMSQNLRSCYQGETEYCPVEAVIASHSPRFALTNGVIFANCINTICRCQDNGKTITQNINQFVSMIDNSTCNDVMVDKFTIKVGKYMGRKDINNINIQIGPQIIIDKVDLSNEINKMNQSLKDSIFYLREAKRILDSVNISLISPSVQLFLIIISVLSFIILLIIIVYLYCKSKHSYKYNKFIDDPDYYNDYKRERINGKASKSNNIYYVGD

SEQ ID NO: 642 - protein, 640 aa, Unknown
  Description of Unknown: Bat Paramyxovirus Eid_hel/GH-M74a/GHA/2009 sequence
SRALLRETDNYSNGLIVENLVRNCHHPSKNNLNYTKTQKRDSTIPYRVEERKGHYPKIKHLIDKSYKHIKRGKRRNGHNGNIITIILLLILILKTQMSEGAIHYETLSKIGLIKGITREYKVKGTPSSKDIVIKLIPNVTGLNKCTNISMENYKEQLDKILIPINNIIELYANSTKSAPGNARFAGVIIAGVALGVAAAAQITAGIALHEARQNAERINLLKDSISATNNAVAELQEATGGIVNVITGMQDYINTNLVPQIDKLQCSQIKTALDISLSQYYSEILTVFGPNLQNPVTTSMSIQAISQSFGGNIDLLLNLLGYTANDLLDLLESKSITGQITYINLEHYFMVIRVYYPIMTTISNAYVQELIKISFNVDGSEWVSLVPSYILIRNSYLSNIDISECLITKNSVICRHDFAMPMSYTLKECLTGDTEKCPREAVVTSYVPRFAISGGVIYANCLSTTCQCYQTGKVIAQDGSQTLMMIDNQTCSIVRIEEILISTGKYLGSQEYNTMHVSVGNPVFTDKLDITSQISNINQSIEQSKFYLDKSKAILDKINLNLIGSVPISILFIIAILSLILSIITFVIVMIIVRRYNKYTPLINSDPSSRRSTIQDVYIIPNPGEHSIRSAARSIDRDRD

SEQ ID NO: 643 - protein, 520 aa, Hendra henipavirus
ILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 644 - protein, 519 aa, Mojiang henipavirus
IHYDSLSKVGVIKGLTYNYKIKGSPSTKLMVVKLIPNIDSVKNCTQKQYDEYKNLVRKALEPVKMAIDTMLNNVKSGNNKYRFAGAIMAGVALGVATAATVTAGIALHRSNENAQAIANMKSAIQNTNEAVKQLQLANKQTLAVIDTIRGEINNNIIPVINQLSCDTIGLSVGIRLTQYYSEIITAFGPALQNPVNTRITIQAISSVFNGNFDELLKIMGYTSGDLYEILHSELIRGNIIDVDVDAGYIALEIEFPNLTLVPNAVVQELMPISYNIDGDEWVTLVPRFVLTRTTLLSNIDTSRCTITDSSVICDNDYALPMSHELIGCLQGDTSKCAREKVVSSYVPKFALSDGLVYANCLNTICRCMDTDTPISQSLGATVSLLDNKRCSVYQVGDVLISVGSYLGDGEYNADNVELGPPIVIDKIDIGNQLAGINQTLQEAEDYIEKSEEFLKGVNPSIITLGSMVVLYIFMILIAIVSVIALVLSIKLTVKGNVVRQQFTYTQHVPSMENINYVSH

SEQ ID NO: 645 - protein, 40 aa, Artificial Sequence
  Description of Artificial Sequence: Synthetic polypeptide
  SITE (1)..(40): This sequence may encompass 1-10 "Gly Gly Gly Ser" repeating units
GGGSGGGSGGGSGGGSGGGSGGGSGGGSGGGSGGGSGGGS

SEQ ID NO: 646 - protein, 15 aa, Artificial Sequence
  Description of Artificial Sequence: Synthetic peptide
GGGGSGGGGSGGGGS

SEQ ID NO: 647 - protein, 15 aa, Artificial Sequence
  Description of Artificial Sequence: Synthetic peptide
TTAASGSSGGSSSGA

SEQ ID NO: 648 - protein, 18 aa, Artificial Sequence
  Description of Artificial Sequence: Synthetic peptide
GSTSGSGKPGSGEGSTKG

SEQ ID NO: 649 - protein, 10 aa, Homo sapiens
EGYYYYGMDV

SEQ ID NO: 650 - protein, 9 aa, Homo sapiens
GIAVAGTDY

SEQ ID NO: 651 - protein, 119 aa, Homo sapiens
QVQLVQSGAEVKKPGASVKVSCKASGYTFTGYYMHWVRQAPGQGLEWMGHINPNNGDTNYAQNFQGRVTMTRDTSTSTVYMELSSLRSEDTAVYYCAKEGYYYYGMDVWGQGTTVTVSS

SEQ ID NO: 652 - protein, 118 aa, Homo sapiens
QVQLVQSGAEVKKPGASVKVSCKASGYTFTSYGISWVRQAPGQGLEWMGWISAHNGVTQYAQKFQGRVTMTRDTSTSTVYMELSSLRSEDTAVYYCARGIAVAGTDYWGQGTLVTVSS

SEQ ID NO: 653 - protein, 7 aa, Homo sapiens
GGTFSSY

SEQ ID NO: 654 - protein, 7 aa, Homo sapiens
GGTFNTY

SEQ ID NO: 655 - protein, 7 aa, Homo sapiens
GYTFTGY

SEQ ID NO: 656 - protein, 7 aa, Homo sapiens
GYTFTDY

SEQ ID NO: 657 - protein, 7 aa, Homo sapiens
GYTFTRY

SEQ ID NO: 658 - protein, 7 aa, Homo sapiens
GYTFTSY

SEQ ID NO: 659 - protein, 7 aa, Homo sapiens
GHTFSRH

SEQ ID NO: 660 - protein, 7 aa, Homo sapiens
GGTFSNT

SEQ ID NO: 661 - protein, 7 aa, Homo sapiens
GYTFTRS

SEQ ID NO: 662 - protein, 7 aa, Homo sapiens
GDTFTGY

SEQ ID NO: 663 - protein, 7 aa, Homo sapiens
GYTFTNY

SEQ ID NO: 664 - protein, 7 aa, Homo sapiens
GYGFTRY

SEQ ID NO: 665 - protein, 7 aa, Homo sapiens
GYTFTSR

SEQ ID NO: 666 - protein, 7 aa, Homo sapiens
GFTFSNS

SEQ ID NO: 667 - protein, 7 aa, Homo sapiens
GYTFTTY

SEQ ID NO: 668 - protein, 7 aa, Homo sapiens
GFTFSSY

SEQ ID NO: 669 - protein, 7 aa, Homo sapiens
GGTFSRY

SEQ ID NO: 670 - protein, 7 aa, Homo sapiens
GNTFTSY

SEQ ID NO: 671 - protein, 7 aa, Homo sapiens
GGTFSNY

SEQ ID NO: 672 - protein, 7 aa, Homo sapiens
GGTFTRY

SEQ ID NO: 673 - protein, 7 aa, Homo sapiens
GGTFSRF

SEQ ID NO: 674 - protein, 7 aa, Homo sapiens
GGTFSSH

SEQ ID NO: 675 - protein, 7 aa, Homo sapiens
GGTFGSY

SEQ ID NO: 676 - protein, 7 aa, Homo sapiens
GYIFTDY

SEQ ID NO: 677 - protein, 7 aa, Homo sapiens
GFTFSSF

SEQ ID NO: 678 - protein, 7 aa, Homo sapiens
GFTFDDY

SEQ ID NO: 679 - protein, 7 aa, Homo sapiens
GYTFTDS

SEQ ID NO: 680 - protein, 7 aa, Homo sapiens
GYTFMNY

SEQ ID NO: 681 - protein, 7 aa, Homo sapiens
GYTLNDY

SEQ ID NO: 682 - protein, 7 aa, Homo sapiens
GYTFTNH

SEQ ID NO: 683 - protein, 7 aa, Homo sapiens
GYTFTEN

SEQ ID NO: 684 - protein, 7 aa, Homo sapiens
GYTFASY

SEQ ID NO: 685 - protein, 7 aa, Homo sapiens
GYTFTAY

SEQ ID NO: 686 - protein, 7 aa, Homo sapiens
GYPFTDY

SEQ ID NO: 687 - protein, 7 aa, Homo sapiens
GYTFSDY

SEQ ID NO: 688 - protein, 7 aa, Homo sapiens
GDTFTTH

SEQ ID NO: 689 - protein, 7 aa, Homo sapiens
GDTFTNY

SEQ ID NO: 690 - protein, 7 aa, Homo sapiens
GYTFTDN

SEQ ID NO: 691 - protein, 7 aa, Homo sapiens
GGTSSSY

SEQ ID NO: 692 - protein, 7 aa, Homo sapiens
GGTFTSY

SEQ ID NO: 693 - protein, 7 aa, Homo sapiens
GNTFTSH

SEQ ID NO: 694 - protein, 7 aa, Homo sapiens
GFTFSDY

SEQ ID NO: 695 - protein, 7 aa, Homo sapiens
GYMFTGH

SEQ ID NO: 696 - protein, 7 aa, Homo sapiens
GYIFSNY

SEQ ID NO: 697 - protein, 7 aa, Homo sapiens
GSTFTNY

SEQ ID NO: 698 - protein, 7 aa, Homo sapiens
GGTLSSY

SEQ ID NO: 699 - protein, 7 aa, Homo sapiens
GYTFTSH

SEQ ID NO: 700 - protein, 7 aa, Homo sapiens
GGTFNSY

SEQ ID NO: 701 - protein, 6 aa, Homo sapiens
DPSDGN

SEQ ID NO: 702 - protein, 6 aa, Homo sapiens
DPSSGG

SEQ ID NO: 703 - protein, 6 aa, Homo sapiens
DPSGGN

SEQ ID NO: 704 - protein, 6 aa, Homo sapiens
NPNNGD

SEQ ID NO: 705 - protein, 6 aa, Homo sapiens
NPNSGG

SEQ ID NO: 706 - protein, 6 aa, Homo sapiens
NPNDGS

SEQ ID NO: 707 - protein, 6 aa, Homo sapiens
NPNSGN

SEQ ID NO: 708 - protein, 6 aa, Homo sapiens
SAHNGV

SEQ ID NO: 709 - protein, 6 aa, Homo sapiens
NPSGGS

SEQ ID NO: 710 - protein, 6 aa, Homo sapiens
SPYNGN

SEQ ID NO: 711 - protein, 6 aa, Homo sapiens
NPNSGD

SEQ ID NO: 712 - protein, 6 aa, Homo sapiens
NPSDGD

SEQ ID NO: 713 - protein, 6 aa, Homo sapiens
DPSGGS

SEQ ID NO: 714 - protein, 6 aa, Homo sapiens
DPKSGD

SEQ ID NO: 715 - protein, 6 aa, Homo sapiens
NPGAGS

SEQ ID NO: 716 - protein, 6 aa, Homo sapiens
SGDGGT

SEQ ID NO: 717 - protein, 6 aa, Homo sapiens
IPIFGT

SEQ ID NO: 718 - protein, 5 aa, Homo sapiens
GTGGG

SEQ ID NO: 719 - protein, 6 aa, Homo sapiens
NPSDGS

SEQ ID NO: 720 - protein, 6 aa, Homo sapiens
NPNGGS

SEQ ID NO: 721 - protein, 6 aa, Homo sapiens
NPNTGG

SEQ ID NO: 722 - protein, 6 aa, Homo sapiens
SGSGGS

SEQ ID NO: 723 - protein, 6 aa, Homo sapiens
SGYNGD

SEQ ID NO: 724 - protein, 6 aa, Homo sapiens
SADNGN

SEQ ID NO: 725 - protein, 6 aa, Homo sapiens
SPNSGA

SEQ ID NO: 726 - protein, 6 aa, Homo sapiens
NPKSGA

SEQ ID NO: 727 - protein, 6 aa, Homo sapiens
SESGDS

SEQ ID NO: 728 - protein, 6 aa, Homo sapiens
NPSNGD

SEQ ID NO: 729 - protein, 6 aa, Homo sapiens
SPSDGS

SEQ ID NO: 730 - protein, 6 aa, Homo sapiens
DPEDGE

SEQ ID NO: 731 - protein, 6 aa, Homo sapiens
NPKSGR

SEQ ID NO: 732 - protein, 6 aa, Homo sapiens
NPGGGS

SEQ ID NO: 733 - protein, 6 aa, Homo sapiens
NPKTGD

SEQ ID NO: 734 - protein, 6 aa, Homo sapiens
DPSDGY

SEQ ID NO: 735 - protein, 6 aa, Homo sapiens
MPISGT

SEQ ID NO: 736 - protein, 6 aa, Homo sapiens
SPTSGD

SEQ ID NO: 737 - protein, 6 aa, Homo sapiens
DPSGDI

SEQ ID NO: 738 - protein, 6 aa, Homo sapiens
ETSGGS

SEQ ID NO: 739 - protein, 6 aa, Homo sapiens
SGSGVT

SEQ ID NO: 740 - protein, 6 aa, Homo sapiens
NPDSGG

SEQ ID NO: 741 - protein, 6 aa, Homo sapiens
NPISGG

SEQ ID NO: 742 - protein, 6 aa, Homo sapiens
SADNGD

SEQ ID NO: 743 - protein, 6 aa, Homo sapiens
SPIYGT

SEQ ID NO: 744 - protein, 6 aa, Homo sapiens
NPSGGT

SEQ ID NO: 745 - protein, 6 aa, Homo sapiens
NPKSGN

SEQ ID NO: 746 - protein, 6 aa, Homo sapiens
NPGGGN

SEQ ID NO: 747 - protein, 6 aa, Homo sapiens
TPVFGI

SEQ ID NO: 748 - protein, 6 aa, Homo sapiens
NPRGGS

SEQ ID NO: 749 - protein, 6 aa, Homo sapiens
NPSGGG

SEQ ID NO: 750 - protein, 6 aa, Homo sapiens
NPGSGN

SEQ ID NO: 751 - protein, 6 aa, Homo sapiens
NGDGDD

SEQ ID NO: 752 - protein, 6 aa, Homo sapiens
DPNSGD

SEQ ID NO: 753 - protein, 6 aa, Homo sapiens
NPSDGN

SEQ ID NO: 754 - protein, 6 aa, Homo sapiens
NTYNGN

SEQ ID NO: 755 - protein, 6 aa, Homo sapiens
NPSDGI

SEQ ID NO: 756 - protein, 6 aa, Homo sapiens
NPRDGD

SEQ ID NO: 757 - protein, 11 aa, Homo sapiens
QASQDIRYFLN

SEQ ID NO: 758 - protein, 8 aa, Homo sapiens
GGTFSSYA

SEQ ID NO: 759 - protein, 8 aa, Homo sapiens
GGTFNTYA

SEQ ID NO: 760 - protein, 8 aa, Homo sapiens
GYTFTGYY

SEQ ID NO: 761 - protein, 8 aa, Homo sapiens
GYTFTDYY

SEQ ID NO: 762 - protein, 8 aa, Homo sapiens
GYTFTRYD

SEQ ID NO: 763 - protein, 8 aa, Homo sapiens
GYTFTSYA

SEQ ID NO: 764 - protein, 8 aa, Homo sapiens
GYTFTSYY

SEQ ID NO: 765 - protein, 8 aa, Homo sapiens
GHTFSRHY

SEQ ID NO: 766 - protein, 8 aa, Homo sapiens
GYTFTSYG

SEQ ID NO: 767 - protein, 8 aa, Homo sapiens
GGTFSNTD

SEQ ID NO: 768 - protein, 8 aa, Homo sapiens
GYTFTRSY

SEQ ID NO: 769 - protein, 8 aa, Homo sapiens
GDTFTGYY

SEQ ID NO: 770 - protein, 8 aa, Homo sapiens
GYTFTRYY

SEQ ID NO: 771 - protein, 8 aa, Homo sapiens
GYTFTNYD

SEQ ID NO: 772 - protein, 8 aa, Homo sapiens
GYTFTNYY

SEQ ID NO: 773 - protein, 8 aa, Homo sapiens
GYGFTRYS

SEQ ID NO: 774 - protein, 8 aa, Homo sapiens
GYTFTSRD

SEQ ID NO: 775 - protein, 8 aa, Homo sapiens
GYTFTSYD

SEQ ID NO: 776 - protein, 8 aa, Homo sapiens
GFTFSNSD

SEQ ID NO: 777 - protein, 8 aa, Homo sapiens
GYTFTTYD

SEQ ID NO: 778 - protein, 8 aa, Homo sapiens
GFTFSSYT

SEQ ID NO: 779 - protein, 8 aa, Homo sapiens
GGTFSRYD

SEQ ID NO: 780 - protein, 8 aa, Homo sapiens
GNTFTSYY

SEQ ID NO: 781 - protein, 8 aa, Homo sapiens
GGTFSRYA

SEQ ID NO: 782 - protein, 8 aa, Homo sapiens
GGTFSNYA

SEQ ID NO: 783 - protein, 8 aa, Homo sapiens
GGTFTRYA

SEQ ID NO: 784 - protein, 8 aa, Homo sapiens
GGTFSRFD

SEQ ID NO: 785 - protein, 8 aa, Homo sapiens
GGTFSSHA

SEQ ID NO: 786 - protein, 8 aa, Homo sapiens
GGTFGSYG

SEQ ID NO: 787 - protein, 8 aa, Homo sapiens
GYIFTDYD

SEQ ID NO: 788 - protein, 8 aa, Homo sapiens
GYTFTSYH

SEQ ID NO: 789 - protein, 8 aa, Homo sapiens
GYTFTSYP

SEQ ID NO: 790 - protein, 8 aa, Homo sapiens
GFTFSSFE

SEQ ID NO: 791 - protein, 8 aa, Homo sapiens
GFTFDDYA

SEQ ID NO: 792 - protein, 8 aa, Homo sapiens
GYTFTDSY

SEQ ID NO: 793 - protein, 8 aa, Homo sapiens
GYTFMNYY

SEQ ID NO: 794 - protein, 8 aa, Homo sapiens
GYTLNDYY

SEQ ID NO: 795 - protein, 8 aa, Homo sapiens
GYTFTNHY

SEQ ID NO: 796 - protein, 8 aa, Homo sapiens
GYTFTENE

SEQ ID NO: 797 - protein, 8 aa, Homo sapiens
GYTFASYD

SEQ ID NO: 798 - protein, 8 aa, Homo sapiens
GYTFTAYY

SEQ ID NO: 799 - protein, 8 aa, Homo sapiens
GYTFTDYH

SEQ ID NO: 800 - protein, 8 aa, Homo sapiens
GYPFTDYY

SEQ ID NO: 801 - protein, 8 aa, Homo sapiens
GYTFSDYY

SEQ ID NO: 802 - protein, 8 aa, Homo sapiens
GDTFTTHD

SEQ ID NO: 803 - protein, 8 aa, Homo sapiens
GDTFTNYY

SEQ ID NO: 804 - protein, 8 aa, Homo sapiens
GYTFTDNY

SEQ ID NO: 805 - protein, 8 aa, Homo sapiens
GGTSSSYA

SEQ ID NO: 806 - protein, 8 aa, Homo sapiens
GGTFTSYD

SEQ ID NO: 807 - protein, 8 aa, Homo sapiens
GNTFTSHW

SEQ ID NO: 808 - protein, 8 aa, Homo sapiens
GFTFSDYD

SEQ ID NO: 809 - protein, 8 aa, Homo sapiens
GYMFTGHD

SEQ ID NO: 810 - protein, 8 aa, Homo sapiens
GYIFSNYD

SEQ ID NO: 811 - protein, 8 aa, Homo sapiens
GFTFSSYA

SEQ ID NO: 812 - protein, 8 aa, Homo sapiens
GYTFTTYY

SEQ ID NO: 813 - protein, 8 aa, Homo sapiens
GSTFTNYQ

SEQ ID NO: 814 - protein, 8 aa, Homo sapiens
GGTLSSYD

SEQ ID NO: 815 - protein, 8 aa, Homo sapiens
GYTFTSHA

SEQ ID NO: 816 - protein, 8 aa, Homo sapiens
GGTFNSYG

SEQ ID NO: 817 - protein, 8 aa, Homo sapiens
IDPSDGNT

SEQ ID NO: 818 - protein, 8 aa, Homo sapiens
IDPSSGGT

SEQ ID NO: 819 - protein, 8 aa, Homo sapiens
IDPSGGNT

SEQ ID NO: 820 - protein, 8 aa, Homo sapiens
INPNNGDT

SEQ ID NO: 821 - protein, 8 aa, Homo sapiens
INPNSGGT

SEQ ID NO: 822 - protein, 8 aa, Homo sapiens
INPNDGST

SEQ ID NO: 823 - protein, 8 aa, Homo sapiens
MNPNSGNT

SEQ ID NO: 824 - protein, 8 aa, Homo sapiens
ISAHNGVT

SEQ ID NO: 825 - protein, 8 aa, Homo sapiens
INPSGGST

SEQ ID NO: 826 - protein, 8 aa, Homo sapiens
ISPYNGNT

SEQ ID NO: 827 - protein, 8 aa, Homo sapiens
INPNSGDT

SEQ ID NO: 828 - protein, 8 aa, Homo sapiens
INPSDGDT

SEQ ID NO: 829 - protein, 8 aa, Homo sapiens
IDPSGGST

SEQ ID NO: 830 - protein, 8 aa, Homo sapiens
IDPKSGDT

SEQ ID NO: 831 - protein, 8 aa, Homo sapiens
INPGAGSS

SEQ ID NO: 832 - protein, 8 aa, Homo sapiens
ISGDGGTT

SEQ ID NO: 833 - protein, 8 aa, Homo sapiens
IIPIFGTA

SEQ ID NO: 834 - protein, 7 aa, Homo sapiens
IGTGGGI

SEQ ID NO: 835 - protein, 8 aa, Homo sapiens
INPSDGST

SEQ ID NO: 836 - protein, 8 aa, Homo sapiens
INPNGGSP

SEQ ID NO: 837 - protein, 8 aa, Homo sapiens
INPNTGGT

SEQ ID NO: 838 - protein, 8 aa, Homo sapiens
ISGSGGST

SEQ ID NO: 839 - protein, 8 aa, Homo sapiens
ISGYNGDT

SEQ ID NO: 840 - protein, 8 aa, Homo sapiens
ISADNGNT

SEQ ID NO: 841 - protein, 8 aa, Homo sapiens
ISPNSGAT

SEQ ID NO: 842 - protein, 8 aa, Homo sapiens
INPNSGNT

SEQ ID NO: 843 - protein, 8 aa, Homo sapiens
INPKSGAT

SEQ ID NO: 844 - protein, 8 aa, Homo sapiens
ISESGDSS

SEQ ID NO: 845 - protein, 7 aa, Homo sapiens
IGTGGGT

SEQ ID NO: 846 - protein, 8 aa, Homo sapiens
MNPSNGDT

SEQ ID NO: 847 - protein, 8 aa, Homo sapiens
ISPSDGST

SEQ ID NO: 848 - protein, 8 aa, Homo sapiens
FDPEDGET

SEQ ID NO: 849 - protein, 8 aa, Homo sapiens
INPKSGRT

SEQ ID NO: 850 - protein, 8 aa, Homo sapiens
INPGGGST

SEQ ID NO: 851 - protein, 8 aa, Homo sapiens
MNPKTGDT

SEQ ID NO: 852 - protein, 8 aa, Homo sapiens
IDPSDGYT

SEQ ID NO: 853 - protein, 8 aa, Homo sapiens
IMPISGTT

SEQ ID NO: 854 - protein, 8 aa, Homo sapiens
MSPTSGDT

SEQ ID NO: 855 - protein, 8 aa, Homo sapiens
IDPSGDIT

SEQ ID NO: 856 - protein, 8 aa, Homo sapiens
IETSGGST

SEQ ID NO: 857 - protein, 8 aa, Homo sapiens
ISGSGVTT

SEQ ID NO: 858 - protein, 8 aa, Homo sapiens
INPDSGGT

SEQ ID NO: 859 - protein, 8 aa, Homo sapiens
INPSGGSA

SEQ ID NO: 860 - protein, 8 aa, Homo sapiens
INPISGGT

SEQ ID NO: 861 - protein, 8 aa, Homo sapiens
ISADNGDT

SEQ ID NO: 862 - protein, 8 aa, Homo sapiens
ISPIYGTP

SEQ ID NO: 863 - protein, 8 aa, Homo sapiens
INPSGGTT

SEQ ID NO: 864 - protein, 8 aa, Homo sapiens
MNPKSGNT

SEQ ID NO: 865 - protein, 8 aa, Homo sapiens
INPGGGNA

SEQ ID NO: 866 - protein, 8 aa, Homo sapiens
ITPVFGIA

SEQ ID NO: 867 - protein, 8 aa, Homo sapiens
INPRGGST

SEQ ID NO: 868 - protein, 8 aa, Homo sapiens
MNPNNGDT

SEQ ID NO: 869 - protein, 8 aa, Homo sapiens
INPSGGGT

SEQ ID NO: 870 - protein, 8 aa, Homo sapiens
INPGSGNT

SEQ ID NO: 871 - protein, 8 aa, Homo sapiens
IIPIFGTP

SEQ ID NO: 872 - protein, 8 aa, Homo sapiens
INGDGDDT

SEQ ID NO: 873 - protein, 8 aa, Homo sapiens
IDPNSGDT

SEQ ID NO: 874 - protein, 8 aa, Homo sapiens
VNPSDGNT

SEQ ID NO: 875 - protein, 8 aa, Homo sapiens
INTYNGNT

SEQ ID NO: 876 - protein, 8 aa, Homo sapiens
INPSDGIT

SEQ ID NO: 877 - protein, 8 aa, Homo sapiens
INPRDGDT

SEQ ID NO: 878 - protein, 15 aa, Homo sapiens
AKERAAAGYYYYMDV

SEQ ID NO: 879 - protein, 15 aa, Homo sapiens
AKEHAAGTYYYYMDV

SEQ ID NO: 880 - protein, 12 aa, Homo sapiens
AKEGYYYYGMDV

SEQ ID NO: 881 - protein, 12 aa, Homo sapiens
AKEGDYYYGMDA

SEQ ID NO: 882 - protein, 10 aa, Homo sapiens
ARERGGMPDY

SEQ ID NO: 883 - protein, 9 aa, Homo sapiens
ARGHGIPKY

SEQ ID NO: 884 - protein, 10 aa, Homo sapiens
ARVRSGSPQH

SEQ ID NO: 885 - protein, 13 aa, Homo sapiens
ARGGPWIVDAFDI

SEQ ID NO: 886 - protein, 11 aa, Homo sapiens
ARGIAVAGTDY

SEQ ID NO: 887 - protein, 15 aa, Homo sapiens
AREATWGPYYYYMDV

SEQ ID NO: 888 - protein, 9 aa, Homo sapiens
VRNKDGLQH

SEQ ID NO: 889 - protein, 15 aa, Homo sapiens
AKDAKRVGYYYYMDV

SEQ ID NO: 890 - protein, 10 aa, Homo sapiens
ARLVGGSPDY

SEQ ID NO: 891 - protein, 8 aa, Homo sapiens
ARGAMVDY

SEQ ID NO: 892 - protein, 15 aa, Homo sapiens
ARGNYVGSYYYGMDV

SEQ ID NO: 893 - protein, 12 aa, Homo sapiens
ARDSRGDWYFDL

SEQ ID NO: 894 - protein, 11 aa, Homo sapiens
TRHGGRGLADY

SEQ ID NO: 895 - protein, 15 aa, Homo sapiens
ARLKELSSILDAFDI

SEQ ID NO: 896 - protein, 15 aa, Homo sapiens
ARERFGTGYYYYMDV

SEQ ID NO: 897 - protein, 14 aa, Homo sapiens
ARVIGEMVDDAFDL

SEQ ID NO: 898 - protein, 15 aa, Homo sapiens
ARERLFGTYYYYMDV

SEQ ID NO: 899 - protein, 10 aa, Homo sapiens
ARADGELTDY

SEQ ID NO: 900 - protein, 15 aa, Homo sapiens
ARHHLPAHYYYYMDV

SEQ ID NO: 901 - protein, 15 aa, Homo sapiens
ARDVPAGRYYYYMDV

SEQ ID NO: 902 - protein, 15 aa, Homo sapiens
AKDRGVGRYYYYMDV

SEQ ID NO: 903 - protein, 15 aa, Homo sapiens
AKDSRYGRYYYYMDV

SEQ ID NO: 904 - protein, 15 aa, Homo sapiens
AKEIVVGPYYYYMDV

SEQ ID NO: 905 - protein, 15 aa, Homo sapiens
ARGMVRGPYYYYMDV

SEQ ID NO: 906 - protein, 15 aa, Homo sapiens
AREGVTGPYYYYMDV

SEQ ID NO: 907 - protein, 18 aa, Homo sapiens
ARDAAAGTRYYYYYGMDV

SEQ ID NO: 908 - protein, 15 aa, Homo sapiens
ARELYSSTYYYYMDV

SEQ ID NO: 909 - protein, 15 aa, Homo sapiens
ARALYSGPYYYYMDV

SEQ ID NO: 910 - protein, 15 aa, Homo sapiens
ARDSLVGRYYYYMDV

SEQ ID NO: 911 - protein, 8 aa, Homo sapiens
ARRSELDY

SEQ ID NO: 912 - protein, 8 aa, Homo sapiens
ARGDDNDY

SEQ ID NO: 913 - protein, 8 aa, Homo sapiens
ARGEEVDY

SEQ ID NO: 914 - protein, 9 aa, Homo sapiens
ARGRRVPDY

SEQ ID NO: 915 - protein, 9 aa, Homo sapiens
ARGKVTTDY

SEQ ID NO: 916 - protein, 9 aa, Homo sapiens
ASGRELIEY

SEQ ID NO: 917 - protein, 9 aa, Homo sapiens
ARVYDFPDV

SEQ ID NO: 918 - protein, 10 aa, Homo sapiens
ARSTYSHIDY

SEQ ID NO: 919 - protein, 10 aa, Homo sapiens
AREDSSGFDY

SEQ ID NO: 920 - protein, 10 aa, Homo sapiens
ARDQGGGFDY

SEQ ID NO: 921 - protein, 10 aa, Homo sapiens
ARDQGWGMDV

SEQ ID NO: 922 - protein, 10 aa, Homo sapiens
ARLTEGIPDY

SEQ ID NO: 923 - protein, 10 aa, Homo sapiens
ARDRYGPFDY

SEQ ID NO: 924 - protein, 11 aa, Homo sapiens
TRLVAGGAPDY

SEQ ID NO: 925 - protein, 11 aa, Homo sapiens
ARDGFTGDIAY

SEQ ID NO: 926 - protein, 11 aa, Homo sapiens
ARVDDSSSPDY

SEQ ID NO: 927 - protein, 11 aa, Homo sapiens
TTGPDGTEVDY

SEQ ID NO: 928 - protein, 11 aa, Homo sapiens
ASSESGSDLDY

SEQ ID NO: 929 - protein, 12 aa, Homo sapiens
AREVEIEGYMDV

SEQ ID NO: 930 - protein, 12 aa, Homo sapiens
AKDLDDDWYMDV

SEQ ID NO: 931 - protein, 12 aa, Homo sapiens
TTDSTTWDAFDI

SEQ ID NO: 932 - protein, 12 aa, Homo sapiens
ARVLVGSGSPDY

SEQ ID NO: 933 - protein, 12 aa, Homo sapiens
AREAAAGLDFQH

SEQ ID NO: 934 - protein, 13 aa, Homo sapiens
ARANSWDAMVIDY

SEQ ID NO: 935 - protein, 13 aa, Homo sapiens
AREHSSSWYTFDY

SEQ ID NO: 936 - protein, 13 aa, Homo sapiens
ARDDDSSGYYLDY

SEQ ID NO: 937 - protein, 13 aa, Homo sapiens
ARASGDYMDLIDY

SEQ ID NO: 938 - protein, 13 aa, Homo sapiens
ALVGSSGYLAPTH

SEQ ID NO: 939 - protein, 13 aa, Homo sapiens
ARVRGDGYNLGDY

SEQ ID NO: 940 - protein, 13 aa, Homo sapiens
ARDVDTAMGAGDY

SEQ ID NO: 941 - protein, 14 aa, Homo sapiens
ARVARWGYGDYPDY

SEQ ID NO: 942 - protein, 14 aa, Homo sapiens
ARDRNGDYYYGMDV

SEQ ID NO: 943 - protein, 14 aa, Homo sapiens
AREGLGSSWYVLDY

SEQ ID NO: 944 - protein, 14 aa, Homo sapiens
ARDGSHYGYYGMDV

SEQ ID NO: 945 - protein, 14 aa, Homo sapiens
ASPGPEGYYYGMDV

SEQ ID NO: 946 - protein, 14 aa, Homo sapiens
ASYHWDYGDYRFDY

SEQ ID NO: 947 - protein, 14 aa, Homo sapiens
ARVEIDYGDSPPDY

SEQ ID NO: 948 - protein, 14 aa, Homo sapiens
ARGAEWELRYAFDI

SEQ ID NO: 949 - protein, 15 aa, Homo sapiens
ARETYYGLYYYGMDV

SEQ ID NO: 950 - protein, 15 aa, Homo sapiens
ARAPSLRGYSYGPDY

SEQ ID NO: 951 - protein, 15 aa, Homo sapiens
AKDRQERYYYYYMDV

SEQ ID NO: 952 - protein, 15 aa, Homo sapiens
AKDRSYGDYYYGMDV

SEQ ID NO: 953 - protein, 15 aa, Homo sapiens
AREVFSENYYYYMDV

SEQ ID NO: 954 - protein, 15 aa, Homo sapiens
AREWDYTHYYYGMDV

SEQ ID NO: 955 - protein, 15 aa, Homo sapiens
ARGDSSGYYQYYFDY

SEQ ID NO: 956 - protein, 15 aa, Homo sapiens
ARGSWDSSSWYIPEY

SEQ ID NO: 957 - protein, 15 aa, Homo sapiens
ASLVWGGAYYYYMDV

SEQ ID NO: 958 - protein, 15 aa, Homo sapiens
TTPVFSGSYYWYFDP

SEQ ID NO: 959 - protein, 16 aa, Homo sapiens
TTDQAVAGPYYYGMDV

SEQ ID NO: 960 - protein, 16 aa, Homo sapiens
ARDRWLAGPYYYGMDV

SEQ ID NO: 961 - protein, 16 aa, Homo sapiens
ARVMGPVDYYYYGMDV

SEQ ID NO: 962 - protein, 16 aa, Homo sapiens
ARDLGPFGSYYYYMDV

SEQ ID NO: 963 - protein, 16 aa, Homo sapiens
AREGVVVPPYYYYMDV

SEQ ID NO: 964 - protein, 16 aa, Homo sapiens
ARSSGWSRYYYYYMDV

SEQ ID NO: 965 - protein, 16 aa, Homo sapiens
ARDNGMTTGYYYYMDV

SEQ ID NO: 966 - protein, 16 aa, Homo sapiens
ARDRAMVTGYYYGMDV

SEQ ID NO: 967 - protein, 17 aa, Homo sapiens
ARDRGYGDRGYYYGMDV

SEQ ID NO: 968 - protein, 17 aa, Homo sapiens
ATSPKATADYYYYYMDV

SEQ ID NO: 969 - protein, 17 aa, Homo sapiens
TTSTVTPSYYYYYGMDV

SEQ ID NO: 970 - protein, 18 aa, Homo sapiens
AREPVAGTGYYYYYGMDV

SEQ ID NO: 971 - protein, 19 aa, Homo sapiens
ARDNLAGFWSDYYYYGMDV

SEQ ID NO: 972 - protein, 6 aa, Homo sapiens
QSISSY

SEQ ID NO: 973 - protein, 6 aa, Homo sapiens
QDISNY

SEQ ID NO: 974 - protein, 11 aa, Homo sapiens
QSLLHSNGYNY

SEQ ID NO: 975 - protein, 6 aa, Homo sapiens
QSISRN

SEQ ID NO: 976 - protein, 7 aa, Homo sapiens
QSVSASD

SEQ ID NO: 977 - protein, 6 aa, Homo sapiens
QDIGNY

SEQ ID NO: 978 - protein, 6 aa, Homo sapiens
QSISTH

SEQ ID NO: 979 - protein, 6 aa, Homo sapiens
QTISNY

SEQ ID NO: 980 - protein, 6 aa, Homo sapiens
QGIRND

SEQ ID NO: 981 - protein, 6 aa, Homo sapiens
QSISNY

SEQ ID NO: 982 - protein, 6 aa, Homo sapiens
QGISDS

SEQ ID NO: 983 - protein, 6 aa, Homo sapiens
QDIHNY

SEQ ID NO: 984 - protein, 6 aa, Homo sapiens
QSISDW

SEQ ID NO: 985 - protein, 6 aa, Homo sapiens
QSISTW

SEQ ID NO: 986 - protein, 6 aa, Homo sapiens
QSINRF

SEQ ID NO: 987 - protein, 6 aa, Homo sapiens
QSVSTY

SEQ ID NO: 988 - protein, 6 aa, Homo sapiens
QDIAKY

SEQ ID NO: 989 - protein, 6 aa, Homo sapiens
QGITNY

SEQ ID NO: 990 - protein, 6 aa, Homo sapiens
QDISNF

SEQ ID NO: 991 - protein, 6 aa, Homo sapiens
QGISNN

SEQ ID NO: 992 - protein, 6 aa, Homo sapiens
QSISRS

SEQ ID NO: 993 - protein, 6 aa, Homo sapiens
HDISKS

SEQ ID NO: 994 - protein, 6 aa, Homo sapiens
QDIGAY

SEQ ID NO: 995 - protein, 6 aa, Homo sapiens
QGIRSY

SEQ ID NO: 996 - protein, 6 aa, Homo sapiens
QNIGTW

SEQ ID NO: 997 - protein, 6 aa, Homo sapiens
QTISYY

SEQ ID NO: 998 - protein, 6 aa, Homo sapiens
QNINNY

SEQ ID NO: 999 - protein, 6 aa, Homo sapiens
QTISTY

SEQ ID NO: 1000 - protein, 6 aa, Homo sapiens
RGIGND

SEQ ID NO: 1001 - protein, 6 aa, Homo sapiens
QTIGNY

SEQ ID NO: 1002 - protein, 6 aa, Homo sapiens
QFIGSW

SEQ ID NO: 1003 - protein, 6 aa, Homo sapiens
QSISSW

SEQ ID NO: 1004 - protein, 12 aa, Homo sapiens
QSVLYSSNNKNY

SEQ ID NO: 1005 - protein, 6 aa, Homo sapiens
QGISSY

SEQ ID NO: 1006 - protein, 6 aa, Homo sapiens
QGISNY

SEQ ID NO: 1007 - protein, 6 aa, Homo sapiens
QSIRNY

SEQ ID NO: 1008 - protein, 6 aa, Homo sapiens
QNIRLY

SEQ ID NO: 1009 - protein, 6 aa, Homo sapiens
QDIRKF

SEQ ID NO: 1010 - protein, 6 aa, Homo sapiens
QNVRSW

SEQ ID NO: 1011 - protein, 6 aa, Homo sapiens
QGIGND

SEQ ID NO: 1012 - protein, 6 aa, Homo sapiens
QSISNW

SEQ ID NO: 1013 - protein, 6 aa, Homo sapiens
ESIGSW

SEQ ID NO: 1014 - protein, 7 aa, Homo sapiens
QSVTSNY

SEQ ID NO: 1015 - protein, 6 aa, Homo sapiens
QGISNG

SEQ ID NO: 1016 - protein, 6 aa, Homo sapiens
QNIRNY

SEQ ID NO: 1017 - protein, 6 aa, Homo sapiens
LDINNY

SEQ ID NO: 1018 - protein, 6 aa, Homo sapiens
QNIGNY

SEQ ID NO: 1019 - protein, 6 aa, Homo sapiens
QGINTW

SEQ ID NO: 1020 - protein, 6 aa, Homo sapiens
QDIRYF

SEQ ID NO: 1021 - protein, 3 aa, Homo sapiens
AAS

SEQ ID NO: 1022 - protein, 3 aa, Homo sapiens
LGS

SEQ ID NO: 1023 - protein, 3 aa, Homo sapiens
KAS

SEQ ID NO: 1024 - protein, 3 aa, Homo sapiens
GAS

SEQ ID NO: 1025 - protein, 3 aa, Homo sapiens
DAS

SEQ ID NO: 1026 - protein, 3 aa, Homo sapiens
SAS

SEQ ID NO: 1027 - protein, 3 aa, Homo sapiens
SAF

SEQ ID NO: 1028 - protein, 3 aa, Homo sapiens
EAS

SEQ ID NO: 1029 - protein, 3 aa, Homo sapiens
MGS

SEQ ID NO: 1030 - protein, 3 aa, Homo sapiens
WAS

SEQ ID NO: 1031 - protein, 3 aa, Homo sapiens
KTS

SEQ ID NO: 1032 - protein, 3 aa, Homo sapiens
TAS

SEQ ID NO: 1033 - protein, 3 aa, Homo sapiens
LAS

SEQ ID NO: 1034 - protein, 3 aa, Homo sapiens
STS

SEQ ID NO: 1035 - protein, 245 aa, Artificial Sequence
  Description of Artificial Sequence: Synthetic polypeptide
QVQLVQSGAEVKKPGASVKVSCKASGGTFSSYAISWVRQAPGQGLEWMGIIDPSDGNTNYAQNFQGRVTMTRDTSTSTVYMELSSLRSEDTAVYYCAKERAAAGYYYYMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR

SEQ ID NO: 1036 - protein, 245 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRGGGGSGGGGSGGGGSQVQLVQSGAEVKKPGASVKVSCKASGGTFSSYAISWVRQAPGQGLEWMGIIDPSDGNTNYAQNFQGRVTMTRDTSTSTVYMELSSLRSEDTAVYYCAKERAAAGYYYYMDVWGQGTTVTVSS

SEQ ID NO: 1037 - protein, 245 aa, Artificial Sequence
  Description of Artificial Sequence: Synthetic polypeptide
QVQLVQSGAEVKKPGASVKVSCKASGGTFSSYAISWVRQAPGQCLEWMGIIDPSDGNTNYAQNFQGRVTMTRDTSTSTVYMELSSLRSEDTAVYYCAKERAAAGYYYYMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGCGTKVEIKR

SEQ ID NO: 1038 - protein, 245 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGCGTKVEIKRGGGGSGGGGSGGGGSQVQLVQSGAEVKKPGASVKVSCKASGGTFSSYAISWVRQAPGQCLEWMGIIDPSDGNTNYAQNFQGRVTMTRDTSTSTVYMELSSLRSEDTAVYYCAKERAAAGYYYYMDVWGQGTTVTVSS

SEQ ID NO: 1039 - protein, 247 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPHTFGQGTKVEIKRGGGGSGGGGSGGGGSQVQLVQSGAEVKKPGASVKVSCKASGYTFTDYYIQWVRQAPGQGLEWMGWINPNSGGTSYAQKFQGRVTMTRDTSTSTVYMELSSLRSEDTAVYYCAKEGDYYYGMDAWGQGTMVTVSS

SEQ ID NO: 1040 - protein, 247 aa, Artificial Sequence
  Description of Artificial Sequence: Synthetic polypeptide
QVQLVQSGAEVKKPGASVKVSCKASGYTFTDYYIQWVRQAPGQGLEWMGWINPNSGGTSYAQKFQGRVTMTRDTSTSTVYMELSSLRSEDTAVYYCAKEGDYYYGMDAWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPHTFGQGTKVEIKR

SEQ ID NO: 1041 - protein, 247 aa, Artificial Sequence
  Description of Artificial Sequence: Synthetic polypeptide
QVQLVQSGAEVKKPGASVKVSCKASGYTFTDYYIQWVRQAPGQCLEWMGWINPNSGGTSYAQKFQGRVTMTRDTSTSTVYMELSSLRSEDTAVYYCAKEGDYYYGMDAWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPHTFGCGTKVEIKR

SEQ ID NO: 1042 - protein, 247 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPHTFGCGTKVEIKRGGGGSGGGGSGGGGSQVQLVQSGAEVKKPGASVKVSCKASGYTFTDYYIQWVRQAPGQCLEWMGWINPNSGGTSYAQKFQGRVTMTRDTSTSTVYMELSSLRSEDTAVYYCAKEGDYYYGMDAWGQGTMVTVSS

SEQ ID NO: 1043 - protein, 240 aa, Artificial Sequence
  Description of Artificial Sequence: Synthetic polypeptide
QVQLVQSGAEVKKPGASVKVSCKASGYTFTSYYMHWVRQAPGQCLEWMGGFDPEDGETIYAQKFQGRVTMTRDTSTSTVYMELSSLRSEDTAVYYCARDQGWGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQTYSTPYTFGCGTKLEIKR

SEQ ID NO: 1044 - protein, 240 aa, Artificial Sequence
  Description of Artificial Sequence: Synthetic polypeptide
QVQLVQSGAEVKKPGASVKVSCKASGYTFTSYYMHWVRQAPGQGLEWMGGFDPEDGETIYAQKFQGRVTMTRDTSTSTVYMELSSLRSEDTAVYYCARDQGWGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQTYSTPYTFGQGTKLEIKR

SEQ ID NO: 1045 - protein, 240 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQTYSTPYTFGCGTKLEIKRGGGGSGGGGSGGGGSQVQLVQSGAEVKKPGASVKVSCKASGYTFTSYYMHWVRQAPGQCLEWMGGFDPEDGETIYAQKFQGRVTMTRDTSTSTVYMELSSLRSEDTAVYYCARDQGWGMDVWGQGTTVTVSS

SEQ ID NO: 1046 - protein, 240 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQTYSTPYTFGQGTKLEIKRGGGGSGGGGSGGGGSQVQLVQSGAEVKKPGASVKVSCKASGYTFTSYYMHWVRQAPGQGLEWMGGFDPEDGETIYAQKFQGRVTMTRDTSTSTVYMELSSLRSEDTAVYYCARDQGWGMDVWGQGTTVTVSS

SEQ ID NO: 1047 - protein, 241 aa, Artificial Sequence
  Description of Artificial Sequence: Synthetic polypeptide
DIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGGGTKVEIKRGGGGSGGGGSGGGGSQVQLVQSGAEVKKPGASVKVSCKASGYTFTNHYMHWVRQAPGQGLEWMGWMNPNSGNTGYAQKFQGRVTMTRDTSTSTVYMELSSLRSEDTAVYYCASSESGSDLDYWGQGTLVTVSS

SEQ ID NO: 1048 - protein, 241 aa, Artificial Sequence
  Description of Artificial Sequence: Synthetic polypeptide
QVQLVQSGAEVKKPGASVKVSCKASGYTFTNHYMHWVRQAPGQGLEWMGWMNPNSGNTGYAQKFQGRVTMTRDTSTSTVYMELSSLRSEDTAVYYCASSESGSDLDYWGQGTLVTVSSGGGGSGGGGSGGGGSDIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGGGTKVEIKR

SEQ ID NO: 1049 - protein, 241 aa, Artificial Sequence
  Description of Artificial Sequence: Synthetic polypeptide
QVQLVQSGAEVKKPGASVKVSCKASGYTFTNHYMHWVRQAPGQCLEWMGWMNPNSGNTGYAQKFQGRVTMTRDTSTSTVYMELSSLRSEDTAVYYCASSESGSDLDYWGQGTLVTVSSGGGGSGGGGSGGGGSDIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGCGTKVEIKR

SEQ ID NO: 1050 - protein, 241 aa, Artificial Sequence
  Description of Artificial Sequence: Synthetic polypeptide
DIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGCGTKVEIKRGGGGSGGGGSGGGGSQVQLVQSGAEVKKPGASVKVSCKASGYTFTNHYMHWVRQAPGQCLEWMGWMNPNSGNTGYAQKFQGRVTMTRDTSTSTVYMELSSLRSEDTAVYYCASSESGSDLDYWGQGTLVTVSS

SEQ ID NO: 1051 - protein, 241 aa, Artificial Sequence
  Description of Artificial Sequence: Synthetic polypeptide
QVQLVQSGAEVKKPGASVKVSCKASGYTFTNHYMHWVRQAPGQGLEWMGIINPNSGNTGYAQKFQGRVTMTRDTSTSTVYMELSSLRSEDTAVYYCASSESGSDLDYWGQGTLVTVSSGGGGSGGGGSGGGGSDIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGGGTKVEIKR

SEQ ID NO: 1052 - protein, 241 aa, Artificial Sequence
  Description of Artificial Sequence: Synthetic polypeptide
DIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGGGTKVEIKRGGGGSGGGGSGGGGSQVQLVQSGAEVKKPGASVKVSCKASGYTFTNHYMHWVRQAPGQGLEWMGIINPNSGNTGYAQKFQGRVTMTRDTSTSTVYMELSSLRSEDTAVYYCASSESGSDLDYWGQGTLVTVSS

SEQ ID NO: 1053 - protein, 829 aa, Artificial Sequence
  Description of Artificial Sequence: Synthetic polypeptide
MKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVQSGAEVKKPGASVKVSCKASGGTFSSYAISWVRQAPGQGLEWMGIIDPSDGNTNYAQNFQGRVTMTRDTSTSTVYMELSSLRSEDTAVYYCAKERAAAGYYYYMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR

SEQ ID NO: 1054 - protein, 831 aa, Artificial Sequence
  Description of Artificial Sequence: Synthetic polypeptide
MKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVQSGAEVKKPGASVKVSCKASGYTFTDYYIQWVRQAPGQGLEWMGWINPNSGGTSYAQKFQGRVTMTRDTSTSTVYMELSSLRSEDTAVYYCAKEGDYYYGMDAWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPHTFGQGTKVEIKR

SEQ ID NO: 1055 - protein, 824 aa, Artificial Sequence
  Description of Artificial Sequence: Synthetic polypeptide
MKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVQSGAEVKKPGASVKVSCKASGYTFTSYYMHWVRQAPGQGLEWMGGFDPEDGETIYAQKFQGRVTMTRDTSTSTVYMELSSLRSEDTAVYYCARDQGWGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQTYSTPYTFGQGTKLEIKR

SEQ ID NO: 1056 - protein, 825 aa, Artificial Sequence
  Description of Artificial Sequence: Synthetic polypeptide
MKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVQSGAEVKKPGASVKVSCKASGYTFTNHYMHWVRQAPGQGLEWMGWMNPNSGNTGYAQKFQGRVTMTRDTSTSTVYMELSSLRSEDTAVYYCASSESGSDLDYWGQGTLVTVSSGGGGSGGGGSGGGGSDIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGGGTKVEIKR

SEQ ID NO: 1057 - protein, 17 aa, Artificial Sequence
  Description of Artificial Sequence: Synthetic peptide
RINPNSGGTNYAENFQG

SEQ ID NO: 1058 - protein, 17 aa, Artificial Sequence
  Description of Artificial Sequence: Synthetic peptide
IINPSGGSTSYAQTFQG

SEQ ID NO: 1059 - protein, 17 aa, Artificial Sequence
  Description of Artificial Sequence: Synthetic peptide
IINPSDGSTDYAQKFQG

SEQ ID NO: 1060 - protein, 125 aa, Homo sapiens
QVQLVESGGGLVQAGGSLRLSCAASGRTFSGYVMGWFRQAPGKQRKFVAAISRGGLSTSYADSVKGRFTISRDNAKNTVFLQMNTLKPEDTAVYYCAADRSDLYEITAASNIDSWGQGTLVTVSS

SEQ ID NO: 1061 - protein, 5 aa, Homo sapiens
GYVMG

SEQ ID NO: 1062 - protein, 17 aa, Homo sapiens
AISRGGLSTSYADSVKG

SEQ ID NO: 1063 - protein, 16 aa, Homo sapiens
DRSDLYEITAASNIDS

SEQ ID NO: 1064 - protein, 7 aa, Homo sapiens
GRTFSGY

SEQ ID NO: 1065 - protein, 6 aa, Homo sapiens
SRGGLS

SEQ ID NO: 1066 - protein, 8 aa, Homo sapiens
GRTFSGYV

SEQ ID NO: 1067 - protein, 8 aa, Homo sapiens
ISRGGLST

SEQ ID NO: 1068 - protein, 18 aa, Homo sapiens
AADRSDLYEITAASNIDS

SEQ ID NO: 1069 - protein, 709 aa, Homo sapiens
MKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVESGGGLVQAGGSLRLSCAASGRTFSGYVMGWFRQAPGKQRKFVAAISRGGLSTSYADSVKGRFTISRDNAKNTVFLQMNTLKPEDTAVYYCAADRSDLYEITAASNIDSWGQGTLVTVSS

SEQ ID NO: 1070 - protein, 828 aa, Homo sapiens
KKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVQSGAEVKKPGASVKVSCKASGGTFSSYAISWVRQAPGQGLEWMGIIDPSDGNTNYAQNFQGRVTMTRDTSTSTVYMELSSLRSEDTAVYYCAKERAAAGYYYYMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR

SEQ ID NO: 1071 - protein, 830 aa, Homo sapiens
KKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVQSGAEVKKPGASVKVSCKASGYTFTDYYIQWVRQAPGQGLEWMGWINPNSGGTSYAQKFQGRVTMTRDTSTSTVYMELSSLRSEDTAVYYCAKEGDYYYGMDAWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLQTPHTFGQGTKVEIKR

SEQ ID NO: 1072 - protein, 823 aa, Homo sapiens
KKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVQSGAEVKKPGASVKVSCKASGYTFTSYYMHWVRQAPGQGLEWMGGFDPEDGETIYAQKFQGRVTMTRDTSTSTVYMELSSLRSEDTAVYYCARDQGWGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQTYSTPYTFGQGTKLEIKR

SEQ ID NO: 1073 - protein, 824 aa, Homo sapiens
KKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVQSGAEVKKPGASVKVSCKASGYTFTNHYMHWVRQAPGQGLEWMGWMNPNSGNTGYAQKFQGRVTMTRDTSTSTVYMELSSLRSEDTAVYYCASSESGSDLDYWGQGTLVTVSSGGGGSGGGGSGGGGSDIQMTQSPSSLSASVGDRVTITCRASQTIGNYVNWYQQKPGKAPKLLIYGASNLHTGVPSRFSGSGSGTDFTLTISSLQPEDFATYYCQQTYSAPLTFGGGTKVEIKR

SEQ ID NO: 1074 - protein, 708 aa, Homo sapiens
KKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPAICAEGVYNDAFLIDRINWISAGVFLDSNATAANPVFTVFKDNEILYRAQLASEDTNAQKTITNCFLLKNKIWCISLVEIYDTGDNVIRPKLFAVKIPEQCTGGGGSGGGGSGGGGSQVQLVESGGGLVQAGGSLRLSCAASGRTFSGYVMGWFRQAPGKQRKFVAAISRGGLSTSYADSVKGRFTISRDNAKNTVFLQMNTLKPEDTAVYYCAADRSDLYEITAASNIDSWGQGTLVTVSS

SEQ ID NO: 1075 - protein, 245 aa, Homo sapiens
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 1076 - protein, 242 aa, Homo sapiens
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 1077 - protein, 118 aa, Homo sapiens
QVQLVESGGGLVQPGGSLRLSCAASGFTFTNHAMSWVRQAPGKGLELVSSISGNGRTTYYADSVKGRFTISRDISKNTLDLQMNSLRAEDTAVYYCAKDGGETLVDSRGQGTLVTVSS

SEQ ID NO: 1078 - protein, 119 aa, Homo sapiens
QVQLVESGGGLVQPGGSLRLSCAASGFTFSSHAMTWVRQAPGKGLEWVAAISGSGDFTHYADSVKGRFTISRDNSKNTVSLQMNNLRAEDTAVYYCAKDEDGGSLLGYRGQGTLVTVSS

SEQ ID NO: 1079 - protein, 121 aa, Homo sapiens
EVQLLESGGGLVQPGGSLRLSCAASGFTFSSYAMSWVRQAPGKGLEWVSSISGSGDYIYYADSVKGRFTISRDISKNTLYLQMNSLRAEDTAVYYCAKEGTGANSSLADYRGQGTLVTVSS

SEQ ID NO: 1080 - protein, 119 aa, Homo sapiens
EVQLLESGGGLIQPGGSLRLSCAASGFTFSSHAMTWVRQAPGKGLEWVSAISGSGDYTHYADSVKGRFTISRDNSKNTVYLQMNSLRAEDSAVYYCAKDEDGGSLLGHRGQGTLVTVSS

SEQ ID NO: 1081 - protein, 12 aa, Homo sapiens
ESKYGPPCPPCP

SEQ ID NO: 1082 - protein, 25 aa, Homo sapiens
TTTPAPRPPTPAPTIASQPLSLRPE

SEQ ID NO: 1083 - protein, 39 aa, Homo sapiens
IEVMYPPPYLDNEKSNGTIIHVKGKHLCPSPLFPGPSKP

SEQ ID NO: 1084 - protein, 44 aa, Homo sapiens
ACRPAAGGAVHTRGLDFACDIYIWAPLAGTCGVLLLSLVITLYC

SEQ ID NO: 1085 - protein, 27 aa, Homo sapiens
FWVLVVVGGVLACYSLLVTVAFIIFWV

SEQ ID NO: 1086 - protein, 41 aa, Homo sapiens
RSKRSRLLHSDYMNMTPRRPGPTRKHYQPYAPPRDFAAYRS

SEQ ID NO: 1087 - protein, 42 aa, Homo sapiens
KRGRKKLLYIFKQPFMRPVQTTQEEDGCSCRFPEEEEGGCEL

SEQ ID NO: 1088 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1089 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1090 - protein, 21 aa, Homo sapiens
MEFGLSWLFLVAILKGVQCSR

SEQ ID NO: 1091 - protein, 41 aa, Homo sapiens
RSKRSRGGHSDYMNMTPRRPGPTRKHYQPYAPPRDFAAYRS

SEQ ID NO: 1092 - protein, 498 aa, Artificial Sequence; identical to SEQ ID NO: 613
  Description of Artificial Sequence: Synthetic polypeptide

SEQ ID NO: 1093 - protein, 415 aa, Artificial Sequence
  Description of Artificial Sequence: Synthetic polypeptide
LAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNT

SEQ ID NO: 1094-1105 - skipped (12 entries)

SEQ ID NO: 1106 - protein, 21 aa, Homo sapiens
MALPVTALLLPLALLLHAARP

SEQ ID NO: 1107 - protein, 20 aa, Unknown
  Description of Unknown: IgK signal peptide sequence
METDTLLLWVLLLWVPGSTG

SEQ ID NO: 1108 - protein, 22 aa, Homo sapiens
MLLLVTSLLLCELPHPAFLLIP

SEQ ID NO: 1109 - protein, 45 aa, Homo sapiens
TTTPAPRPPTPAPTIASQPLSLRPEACRPAAGGAVHTRGLDFACD

SEQ ID NO: 1110 - protein, 39 aa, Homo sapiens; identical to SEQ ID NO: 1083

SEQ ID NO: 1111 - protein, 12 aa, Homo sapiens
ESKYGPPCPPCP

SEQ ID NO: 1112 - protein, 12 aa, Homo sapiens
ESKYGPPCPSCP

SEQ ID NO: 1113 - protein, 229 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1114 - protein, 24 aa, Homo sapiens
IYIWAPLAGTCGVLLLSLVITLYC

SEQ ID NO: 1115 - protein, 27 aa, Homo sapiens
FWVLVVVGGVLACYSLLVTVAFIIFWV

SEQ ID NO: 1116 - protein, 42 aa, Homo sapiens; identical to SEQ ID NO: 1087

SEQ ID NO: 1117 - protein, 41 aa, Homo sapiens; identical to SEQ ID NO: 1086

SEQ ID NO: 1118 - protein, 112 aa, Homo sapiens; identical to SEQ ID NO: 1088

SEQ ID NO: 1119 - protein, 245 aa, Artificial Sequence; identical to SEQ ID NO: 1075
  Description of Artificial Sequence: Synthetic polypeptide

SEQ ID NO: 1120 - protein, 107 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 1121 - protein, 6 aa, Artificial Sequence
  Description of Artificial Sequence: Synthetic peptide
QDISKY

SEQ ID NO: 1122 - protein, 3 aa, Artificial Sequence
  Description of Artificial Sequence: Synthetic peptide
HTS

SEQ ID NO: 1123 - protein, 9 aa, Artificial Sequence
  Description of Artificial Sequence: Synthetic peptide
QQGNTLPYT

SEQ ID NO: 1124 - protein, 18 aa, Artificial Sequence
  Description of Artificial Sequence: Synthetic peptide
GSTSGSGKPGSGEGSTKG

SEQ ID NO: 1125 - protein, 120 aa, Artificial Sequence
  Description of Artificial Sequence: Synthetic polypeptide
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 1126 - protein, 8 aa, Artificial Sequence
  Description of Artificial Sequence: Synthetic peptide
GVSLPDYG

SEQ ID NO: 1127 - protein, 7 aa, Artificial Sequence
  Description of Artificial Sequence: Synthetic peptide
IWGSETT

SEQ ID NO: 1128 - protein, 14 aa, Artificial Sequence
  Description of Artificial Sequence: Synthetic peptide
AKHYYYGGSYAMDY

SEQ ID NO: 1129 - protein, 242 aa, Artificial Sequence; identical to SEQ ID NO: 1076
  Description of Artificial Sequence: Synthetic polypeptide

SEQ ID NO: 1130 - protein, 15 aa, Artificial Sequence
  Description of Artificial Sequence: Synthetic peptide
GGGGSGGGGSGGGGS

SEQ ID NO: 1131 - DNA, 1458 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1132 - protein, 486 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1133 - DNA, 1383 bp, Artificial Sequence
  Description of Artificial Sequence: Synthetic polynucleotide
atgctgctgctggtgaccagcctgctgctgtgcgagctgccccaccccgcctttctgctgatccccgacatccagatgacccagaccacctccagcctgagcgccagcctgggcgaccgggtgaccatcagctgccgggccagccaggacatcagcaagtacctgaactggtatcagcagaagcccgacggcaccgtcaagctgctgatctaccacaccagccggctgcacagcggcgtgcccagccggtttagcggcagcggctccggcaccgactacagcctgaccatctccaacctggaacaggaagatatcgccacctacttttgccagcagggcaacacactgccctacacctttggcggcggaacaaagctggaaatcaccggcagcacctccggcagcggcaagcctggcagcggcgagggcagcaccaagggcgaggtgaagctgcaggaaagcggccctggcctggtggcccccagccagagcctgagcgtgacctgcaccgtgagcggcgtgagcctgcccgactacggcgtgagctggatccggcagccccccaggaagggcctggaatggctgggcgtgatctggggcagcgagaccacctactacaacagcgccctgaagagccggctgaccatcatcaaggacaacagcaagagccaggtgttcctgaagatgaacagcctgcagaccgacgacaccgccatctactactgcgccaagcactactactacggcggcagctacgccatggactactggggccagggcaccagcgtgaccgtgagcagcgaatctaagtacggaccgccctgccccccttgccctatgttctgggtgctggtggtggtcggaggcgtgctggcctgctacagcctgctggtcaccgtggccttcatcatcttttgggtgaaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaagg

SEQ ID NO: 1134 - protein, 461 aa, Artificial Sequence
  Description of Artificial Sequence: Synthetic polypeptide
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1135 - DNA, 1467 bp, Artificial Sequence
  Description of Artificial Sequence: Synthetic polynucleotide
atgcttctcctggtgacaagccttctgctctgtgagttaccacacccagcattcctcctgatcccagacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggctccacctctggatccggcaagcccggatctggcgagggatccaccaagggcgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagcggccgcaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1136 - protein, 489 aa, Artificial Sequence
  Description of Artificial Sequence: Synthetic polypeptide
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1137 - protein, 246 aa, Artificial Sequence
  Description of Artificial Sequence: Synthetic polypeptide
DIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKGSTSGSGKPGSGEGSTKGEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 1138 - protein, 106 aa, Artificial Sequence
  Description of Artificial Sequence: Synthetic polypeptide
DIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIK

SEQ ID NO: 1139 - protein, 10 aa, Artificial Sequence
  Description of Artificial Sequence: Synthetic peptide
RASSSVNYMD

SEQ ID NO: 1140 - protein, 7 aa, Artificial Sequence
  Description of Artificial Sequence: Synthetic peptide
ATSNLAS

SEQ ID NO: 1141 - protein, 9 aa, Artificial Sequence
  Description of Artificial Sequence: Synthetic peptide
QQWSFNPPT

SEQ ID NO: 1142 - protein, 122 aa, Artificial Sequence
  Description of Artificial Sequence: Synthetic polypeptide
EVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 1143 - protein, 5 aa, Artificial Sequence
  Description of Artificial Sequence: Synthetic peptide
SYNMH

SEQ ID NO: 1144 - protein, 17 aa, Artificial Sequence
  Description of Artificial Sequence: Synthetic peptide
AIYPGNGDTSYNQKFKG

SEQ ID NO: 1145 - protein, 246 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 1146 - protein, 124 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSS

SEQ ID NO: 1147 - protein, 10 aa, Artificial Sequence
  Description of Artificial Sequence: Synthetic peptide
GDSVSSNSAA

SEQ ID NO: 1148 - protein, 9 aa, Artificial Sequence
  Description of Artificial Sequence: Synthetic peptide
TYYRSKWYN

SEQ ID NO: 1149 - protein, 14 aa, Artificial Sequence
  Description of Artificial Sequence: Synthetic peptide
AREVTGDLEDAFDI

SEQ ID NO: 1150 - protein, 107 aa, Artificial Sequence
  Description of Artificial Sequence: Synthetic polypeptide
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 1151 - protein, 6 aa, Artificial Sequence
  Description of Artificial Sequence: Synthetic peptide
QTIWSY

SEQ ID NO: 1152 - protein, 3 aa, Artificial Sequence
  Description of Artificial Sequence: Synthetic peptide
AAS

SEQ ID NO: 1153 - protein, 9 aa, Artificial Sequence
  Description of Artificial Sequence: Synthetic peptide
QQSYSIPQT

SEQ ID NO: 1154 - protein, 246 aa, Artificial Sequence
  Description of Artificial Sequence: Synthetic polypeptide
QVQLQQSGPGMVKPSQTLSLTCAISGDSVSSNSVAWNWIRQSPSRGLEWLGRTYYRSTWYNDYAVSMKSRITINPDTNKNQFSLQLNSVTPEDTAVYYCAREVTGDLEDAFDIWGQGTMVTVSSGGGGSGGGGSGGGGSDIQMIQSPSSLSASVGDRVTITCRASQTIWSYLNWYRQRPGEAPNLLIYAASSLQSGVPSRFSGRGSGTDFTLTISSLQAEDFATYYCQQSYSIPQTFGQGTKLEIK

SEQ ID NO: 1155 - protein, 124 aa, Artificial Sequence
  Description of Artificial Sequence: Synthetic polypeptide
QVQLQQSGPGMVKPSQTLSLTCAISGDSVSSNSVAWNWIRQSPSRGLEWLGRTYYRSTWYNDYAVSMKSRITINPDTNKNQFSLQLNSVTPEDTAVYYCAREVTGDLEDAFDIWGQGTMVTVSS

SEQ ID NO: 1156 - protein, 10 aa, Artificial Sequence
  Description of Artificial Sequence: Synthetic peptide
GDSVSSNSVA

SEQ ID NO: 1157 - protein, 9 aa, Artificial Sequence
  Description of Artificial Sequence: Synthetic peptide
TYYRSTWYN

SEQ ID NO: 1158 - protein, 14 aa, Artificial Sequence
  Description of Artificial Sequence: Synthetic peptide
AREVTGDLEDAFDI

SEQ ID NO: 1159 - protein, 107 aa, Artificial Sequence
  Description of Artificial Sequence: Synthetic polypeptide
DIQMIQSPSSLSASVGDRVTITCRASQTIWSYLNWYRQRPGEAPNLLIYAASSLQSGVPSRFSGRGSGTDFTLTISSLQAEDFATYYCQQSYSIPQTFGQGTKLEIK

SEQ ID NO: 1160 - protein, 6 aa, Artificial Sequence
  Description of Artificial Sequence: Synthetic peptide
QTIWSY

SEQ ID NO: 1161 - protein, 3 aa, Artificial Sequence
  Description of Artificial Sequence: Synthetic peptide
AAS

SEQ ID NO: 1162 - protein, 9 aa, Artificial Sequence
  Description of Artificial Sequence: Synthetic peptide
QQSYSIPQT

SEQ ID NO: 1163 - protein, 246 aa, Artificial Sequence
  Description of Artificial Sequence: Synthetic polypeptide
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 1164 - protein, 111 aa, Artificial Sequence
  Description of Artificial Sequence: Synthetic polypeptide
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 1165 - protein, 15 aa, Artificial Sequence
  Description of Artificial Sequence: Synthetic peptide
RASESVSVIGAHLIH

SEQ ID NO: 1166 - protein, 7 aa, Artificial Sequence
  Description of Artificial Sequence: Synthetic peptide
LASNLET

SEQ ID NO: 1167 - protein, 9 aa, Artificial Sequence
  Description of Artificial Sequence: Synthetic peptide
LQSRIFPRT

SEQ ID NO: 1168 - protein, 117 aa, Artificial Sequence
  Description of Artificial Sequence: Synthetic polypeptide
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 1169 - protein, 5 aa, Artificial Sequence
  Description of Artificial Sequence: Synthetic peptide
DYSIN

SEQ ID NO: 1170 - protein, 17 aa, Artificial Sequence
  Description of Artificial Sequence: Synthetic peptide
WINTETREPAYAYDFRG

SEQ ID NO: 1171 - protein, 8 aa, Artificial Sequence
  Description of Artificial Sequence: Synthetic peptide
DYSYAMDY

SEQ ID NO: 1172 - protein, 246 aa, Artificial Sequence
  Description of Artificial Sequence: Synthetic polypeptide
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 1173 - protein, 111 aa, Artificial Sequence
  Description of Artificial Sequence: Synthetic polypeptide
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 1174 - protein, 15 aa, Artificial Sequence
  Description of Artificial Sequence: Synthetic peptide
RASESVTILGSHLIY

SEQ ID NO: 1175 - protein, 7 aa, Artificial Sequence
  Description of Artificial Sequence: Synthetic peptide
LASNVQT

SEQ ID NO: 1176 - protein, 9 aa, Artificial Sequence
  Description of Artificial Sequence: Synthetic peptide
LQSRTIPRT

SEQ ID NO: 1177 - protein, 117 aa, Artificial Sequence
  Description of Artificial Sequence: Synthetic polypeptide
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 1178 - protein, 5 aa, Artificial Sequence
  Description of Artificial Sequence: Synthetic peptide
HYSMN

SEQ ID NO: 1179 - protein, 17 aa, Artificial Sequence
  Description of Artificial Sequence: Synthetic peptide
RINTESGVPIYADDFKG

SEQ ID NO: 1180 - protein, 8 aa, Artificial Sequence
  Description of Artificial Sequence: Synthetic peptide
DYLYSLDF

SEQ ID NO: 1181 - protein, 121 aa, Artificial Sequence; identical to SEQ ID NO: 1079
  Description of Artificial Sequence: Synthetic polypeptide

SEQ ID NO: 1182 - protein, 8 aa, Artificial Sequence
  Description of Artificial Sequence: Synthetic peptide
GFTFSSYA

SEQ ID NO: 1183 - protein, 8 aa, Artificial Sequence
  Description of Artificial Sequence: Synthetic peptide
ISGSGDYI

SEQ ID NO: 1184 - protein, 14 aa, Artificial Sequence
  Description of Artificial Sequence: Synthetic peptide
AKEGTGANSSLADY

SEQ ID NO: 1185-1212 - skipped (28 entries)

SEQ ID NO: 1213 - protein, 42 aa, Homo sapiens
AAAIEVMYPPPYLDNEKSNGTIIHVKGKHLCPSPLFPGPSKP

SEQ ID NO: 1214 - protein, 28 aa, Homo sapiens
MFWVLVVVGGVLACYSLLVTVAFIIFWV

SEQ ID NO: 1215 - protein, 112 aa, Artificial Sequence; identical to SEQ ID NO: 1089
  Description of Artificial Sequence: Synthetic polypeptide

SEQ ID NO: 1216 - DNA, 1467 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggctccacctctggatccggcaagcccggatctggcgagggatccaccaagggcgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1217 - protein, 489 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1218 - protein, 243 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQKYDLLTFGGGTKVEIKGSTSGSGKPGSGEGSTKGQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARDRGDTILDVWGQGTMVTVSS

SEQ ID NO: 1219 - protein, 106 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQKYDLLTFGGGTKVEIK

SEQ ID NO: 1220 - protein, 6 aa, Artificial Sequence
  Description of Artificial Sequence: Synthetic peptide
QSISSY

SEQ ID NO: 1221 - protein, 3 aa, Artificial Sequence
  Description of Artificial Sequence: Synthetic peptide
AAS

SEQ ID NO: 1222 - protein, 8 aa, Artificial Sequence
  Description of Artificial Sequence: Synthetic peptide
QQKYDLLT

SEQ ID NO: 1223 - protein, 119 aa, Artificial Sequence
  Description of Artificial Sequence: Synthetic polypeptide
QLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARDRGDTILDVWGQGTMVTVSS

SEQ ID NO: 1224 - protein, 10 aa, Artificial Sequence
  Description of Artificial Sequence: Synthetic peptide
GGSISSSSYY

SEQ ID NO: 1225 - protein, 7 aa, Artificial Sequence
  Description of Artificial Sequence: Synthetic peptide
ISYSGST

SEQ ID NO: 1226 - protein, 11 aa, Artificial Sequence
  Description of Artificial Sequence: Synthetic peptide
ARDRGDTILDV

SEQ ID NO: 1227 - DNA, 1503 bp, Artificial Sequence
  Description of Artificial Sequence: Synthetic polynucleotide
atggccttaccagtgaccgccttgctcctgccgctggccttgctgctccacgccgccaggccggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcagcaaaaatacgacctcctcacttttggcggagggaccaaggttgagatcaaaggcagcaccagcggctccggcaagcctggctctggcgagggcagcacaaagggacagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagagatcgtggagacaccatactagacgtatggggtcagggtacaatggtcaccgtcagctcattcgtgcccgtgttcctgcccgccaaacctaccaccacccctgcccctagacctcccaccccagccccaacaatcgccagccagcctctgtctctgcggcccgaagcctgtagacctgctgccggcggagccgtgcacaccagaggcctggacttcgcctgcgacatctacatctgggcccctctggccggcacctgtggcgtgctgctgctgagcctggtgatcaccctgtactgcaaccaccggaacaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagatccgccgacgcccctgcctaccagcagggacagaaccagctgtacaacgagctgaacctgggcagacgggaagagtacgacgtgctggacaagcggagaggccgggaccccgagatgggcggaaagcccagacggaagaacccccaggaaggcctgtataacgaactgcagaaagacaagatggccgaggcctacagcgagatcggcatgaagggcgagcggaggcgcggcaagggccacgatggcctgtaccagggcctgagcaccgccaccaaggacacctacgacgccctgcacatgcaggccctgccccccaga

SEQ ID NO: 1228 - protein, 501 aa, Artificial Sequence
  Description of Artificial Sequence: Synthetic polypeptide
MALPVTALLLPLALLLHAARPDIQMTQSPSSLSASVGDRVTITCRASQSISSYLNWYQQKPGKAPKLLIYAASSLQSGVPSRFSGSGSGTDFTLTISSLQPEDFATYYCQQKYDLLTFGGGTKVEIKGSTSGSGKPGSGEGSTKGQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARDRGDTILDVWGQGTMVTVSSFVPVFLPAKPTTTPAPRPPTPAPTIASQPLSLRPEACRPAAGGAVHTRGLDFACDIYIWAPLAGTCGVLLLSLVITLYCNHRNKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1229-1230 - skipped (2 entries)

SEQ ID NO: 1231 - protein, 468 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

The invention claimed is:

1. A viral vector targeting CD8+ T cells, comprising:
 i) an antibody fragment that binds CD8;
 ii) a henipavirus envelope glycoprotein G (G protein) or a biologically active portion thereof;
 iii) a henipavirus F protein molecule or biologically active portion thereof; and
 iv) one or more nucleic acid sequences encoding a chimeric antigen receptor (CAR), wherein the antibody fragment comprises three heavy chain complementarity determining regions (HCDR1, HCDR2, and HCDR3) and three light chain complementarity determining regions (LCDR1, LCDR2, and LCDR3), wherein the HCDR1, HCDR2, HCDR3, LCDR1, LCDR2, and LCDR3 comprise:

a) SEQ ID NOs: 1, 70, 148, 240, 294, 333, respectively;

b) SEQ ID NOs: 5, 74, 150, 242, 295, 336, respectively;

c) SEQ ID NOs: 40, 109, 189, 240, 294, 370, respectively; or d) SEQ ID NOs: 43, 77, 196, 270, 320, 375, respectively; and wherein the antibody fragment is attached to the C-terminus of the G protein or the biologically active portion thereof.

2. The viral vector of claim 1, wherein the antibody fragment is attached to the G protein via a peptide linker.

3. The viral vector of claim 2, wherein the peptide linker is (GGGGS)n (SEQ ID NO: 626), wherein n is 1 to 10.

4. The viral vector of claim 3, wherein the peptide linker is (GGGGS)n (SEQ ID NO: 626), wherein n is 3.

5. The viral vector of claim 1, wherein the antibody fragment is a single chain variable fragment (scFv).

6. The viral vector of claim 1, wherein the HCDR1, HCDR2, HCDR3, LCDR1, LCDR2, and LCDR3 comprise SEQ ID NOs: 40, 109, 189, 240, 294, and 370, respectively.

7. The viral vector of claim 1, wherein the antibody fragment comprises a heavy chain variable region (VH), wherein the VH is selected from SEQ ID NOs: 405, 408, 448, and 455.

8. The viral vector of claim 1, wherein the antibody fragment comprises a light chain variable region (VL), wherein the VL is selected from 499, 503, 542, and 549.

9. The viral vector of claim 1, wherein the antibody fragment comprises SEQ ID NO: 1044.

10. The viral vector of claim 1, wherein the G protein is a wild-type Nipah virus G glycoprotein (NiV-G) or a functionally active variant or a biologically active portion thereof.

11. The viral vector of claim 10, wherein the NiV-G variant or biologically active portion thereof comprises an amino acid sequence having at least 95% sequence identity to SEQ ID NO: 600, SEQ ID NO: 618, or SEQ ID NO: 628.

12. The viral vector of claim 11, wherein the NiV-G variant or biologically active portion thereof comprises one or more amino acid substitutions corresponding to amino acid substitutions selected from E501A, W504A, Q530A and E533A with reference to the numbering set forth in SEQ ID NO: 618.

13. The viral vector of claim 11, wherein the NiV-G variant comprises SEQ ID NO: 607 or 635.

14. The viral vector of claim 1, wherein the F protein is a wild-type Nipah virus F (NiV-F) protein or a functionally active variant or a biologically active portion thereof.

15. The viral vector of claim 13, wherein the NiV-F comprises an amino acid sequence having at least 95% sequence identity to SEQ ID NO: 593, SEQ ID NO: 594, SEQ ID NO: 596, SEQ ID NO: 597, SEQ ID NO: 599, SEQ ID NO: 1092, or SEQ ID NO: 1093.

16. The viral vector of claim 1, wherein the antibody fragment attached to the C-terminus of the G protein comprises SEQ ID NO: 1055 or SEQ ID NO: 1072.

17. The viral vector of claim 1, wherein the CAR targets a tumor antigen selected from CD19, CD20, CD22, or BCMA.

18. The viral vector of claim 17, wherein the CAR comprises an anti-CD19 scFv having an amino acid sequence comprising SEQ ID NO: 1075.

19. The viral vector of claim 17, wherein the CAR comprises one or more intracellular domains selected from a CD137 (4-1BB) signaling domain, a CD28 signaling domain, and a CD3zeta signaling domain.

20. The viral vector of claim 1, wherein the viral vector is a lentiviral vector.

21. The viral vector of claim 1, further comprising a viral protein selected from one or more of Gag, Pol, Rev, and Tat.

22. The viral vector of claim 1, further comprising one or more of the following nucleic acid sequences: a 5' LTR, a Psi packaging element, a central polypurine tract (cPPT)/central termination sequence (CTS), a Poly A tail sequence, a posttranscriptional regulatory element, a Rev response element (RRE), and a 3' LTR.

23. A method of treating cancer, comprising administering to a subject in need thereof an effective amount of a composition comprising a lipid particle comprising an antibody fragment that binds CD8, a henipavirus envelope glycoprotein G (G protein) or a biologically active portion thereof, a henipavirus F protein molecule or biologically active portion thereof, and a chimeric antigen receptor (CAR), wherein the antibody fragment comprises three heavy chain complementarity determining regions (HCDR1, HCDR2, and HCDR3) and three light chain complementarity determining regions (LCDR1, LCDR2, and LCDR3), wherein the HCDR1, HCDR2, HCDR3, LCDR1, LCDR2, and LCDR3 comprise:

a) SEQ ID NOs: 1, 70, 148, 240, 294, 333, respectively;
b) SEQ ID NOs: 5, 74, 150, 242, 295, 336, respectively;
c) SEQ ID NOs: 40, 109, 189, 240, 294, 370, respectively; or
d) SEQ ID NOs: 43, 77, 196, 270, 320, 375, respectively.

24. The viral vector of claim 15, wherein the NiV-F comprises SEQ ID NO: 593, SEQ ID NO: 594, SEQ ID NO: 596, SEQ ID NO: 597, SEQ ID NO: 599, SEQ ID NO: 1092, or SEQ ID NO: 1093.

25. The viral vector of claim 1, wherein the antibody fragment comprises a heavy chain variable region (VH) comprising SEQ ID NO: 448 and a light chain variable region (VL) comprising SEQ ID NO: 542.

26. The viral vector of claim 9, wherein the G protein or the biologically active portion thereof comprises SEQ ID NO: 635.

27. The viral vector of claim 26, wherein the CAR comprises an anti-CD19 scFv having a light chain variable region comprising SEQ ID NO: 1120 and a heavy chain variable region comprising SEQ ID NO: 1125.

28. The viral vector of claim 27, wherein the anti-CD19 scFv has an amino acid sequence comprising SEQ ID NO: 1075.

29. The viral vector of claim 28, wherein the CAR has an amino acid sequence comprising SEQ ID NO: 1231.

30. The viral vector of claim 29, wherein the NiV-F comprises SEQ ID NO: 593, SEQ ID NO: 594, SEQ ID NO: 596, SEQ ID NO: 597, SEQ ID NO: 599, SEQ ID NO: 1092, or SEQ ID NO: 1093.

* * * * *